(12) United States Patent
Zotchev et al.

(10) Patent No.: US 7,709,231 B2
(45) Date of Patent: May 4, 2010

(54) GENES ENCODING A NYSTATIN POLYKETIDE SYNTHASE AND THEIR MANIPULATION AND UTILITY

(75) Inventors: Sergey Borisovich Zotchev, Trondheim (NO); Olga Nikolayivna Sekurova, Trondheim (NO); Espen Fjærvik, Trondheim (NO); Trygve Brautaset, Trondheim (NO); Arne Reidar Strøm, Trondheim (NO); Svein Valla, Vikhamar (NO); Trond Erling Ellingsen, Ranheim (NO); Håvard Sletta, Trondheim (NO); Ole-Martin Gulliksen, Oslo (NO)

(73) Assignee: Sinvent AS, Trondheim (NO)

( * ) Notice: Subject to any disclaimer, the term of this patent is extended or adjusted under 35 U.S.C. 154(b) by 747 days.

(21) Appl. No.: 11/518,287

(22) Filed: Sep. 11, 2006

(65) Prior Publication Data

US 2008/0119541 A1    May 22, 2008

Related U.S. Application Data

(63) Continuation of application No. 10/203,295, filed as application No. PCT/GB01/00509 on Feb. 8, 2001, now Pat. No. 7,141,660.

(30) Foreign Application Priority Data

| Feb. 8, 2000 | (GB) | ................................. | 0002840.7 |
| Apr. 10, 2000 | (GB) | ................................. | 0008786.6 |
| Apr. 14, 2000 | (GB) | ................................. | 0009387.2 |

(51) Int. Cl.
*C12P 19/34* (2006.01)
*C12P 19/62* (2006.01)
*C12N 15/74* (2006.01)
*C07H 21/00* (2006.01)

(52) U.S. Cl. ..................... 435/91.1; 435/91.4; 435/91.5; 435/471; 435/76; 536/23.4

(58) Field of Classification Search ....................... None
See application file for complete search history.

(56) References Cited

U.S. PATENT DOCUMENTS

| 5,210,226 A | 5/1993 | Pandey |
| 5,314,999 A | 5/1994 | Seman et al. |
| 5,981,721 A | 11/1999 | Mohan |

FOREIGN PATENT DOCUMENTS

| EP | 0 791 655 A2 | 8/1997 |
| WO | WO 95/29253 A1 | 11/1995 |
| WO | WO 96/40968 A1 | 12/1996 |
| WO | WO 98/49315 A2 | 11/1998 |
| WO | WO 00/77222 A1 | 12/2000 |

OTHER PUBLICATIONS

Aparicio, "*Streptomyces natalensis* pimS1 gene," Apr. 20, 1999, Database EM PRO entry ID SNA132222.

Aparicio, Jesús F., et al., "The Biosynthetic Gene Cluster for the 26-Membered Ring Polyene Macrolide Pimaricin," *The Journal of Biological Chemistry*, Apr. 9, 1999, pp. 10133-10139, vol. 274, No. 15. The American Society for Biochemistry and Molecular Biology, Inc.

Bisang, Christian, "A chain initiation factor common to both modular and aromatic polyketide synthases," *Nature*, Sep. 30, 1999, pp. 502-505, vol. 401. Macmillan Magazines Ltd.

Brautaset, Trygve, et al., "Biosynthesis of the polyene antifungal antibiotic nystatin in *Streptomyces noursei* ATCC 11455: analysis of the gene cluster and deduction of the biosynthetic pathway," *Chemistry & Biology 2000*, pp. 395-403, vol. 7. Elsevier Science Ltd.

Ciftci, T., et al., "Comparative Analysis of Hexaene Antibiotics," *The Journal of Antibiotics*, Aug. 1984, pp. 876-884, vol. 37, No. 8.

Cox, Russell J., "Post-transitional modification of heterologously expressed *Streptomyces* type II polyketide synthase acyl carrier proteins," *FEBS Letters*, 1997, pp. 267-272, vol. 405. Federation of European Biochemical Societies.

Decker, Henrich, et al., "A general approach for cloning and characterizing dNDP-glucose dehydratase genes from actinomycetes," *FEMS Microbiology Letters*, 1996, pp. 195-201, vol. 141. Elsevier Science B.V.

Donadio, Stefano, "An erythromycin analog produced by reprogramming of polyketide synthesis," *Proc. Natl. Acad. Sci. USA*, Aug. 1993, pp. 7119-7123, vol. 90.

Donadio, Stefano et al., "Modular Organization of Genes Required for Complex Polyketide Biosynthesis," *Science*, May 3, 1991, pp. 675-679, vol. 252.

(Continued)

*Primary Examiner*—David J Steadman
*Assistant Examiner*—Alexander D Kim
(74) *Attorney, Agent, or Firm*—Rothwell, Figg, Ernst & Manbeck

(57) ABSTRACT

The invention provides a nucleic acid molecule comprising: (a) a nucleotide sequence as shown in SEQ ID No. 35; or (b) a nucleotide sequence which is the complement of SEQ ID No. 35; or (c) a nucleotide sequence which is degenerate with SEQ ID No. 35; or (d) a nucleotide sequence hybridising under conditions of high stringency to SEQ ID No. 35, to the complement of SEQ ID No. 35, or to a hybridisation probe derived from SEQ ID No. 35 or the complement thereof; or (e) a nucleotide sequence having at least 80% sequence identity with SEQ ID No. 35; or (f) a nucleotide sequence having at least 65% sequence identity with SEQ ID No. 35 wherein said sequence preferably encodes or is complementary to a sequence encoding a nystatin PKS enzyme or a part thereof. Also provided are part of such molecules and polypeptides (and parts thereof) encoded by such a nucleic acid molecule, and the use of such molecules and polypeptides in facilitating nystatin biosynthesis and in the synthesis of nystatin derivatives and novel polyketide as macrolide structures.

23 Claims, 12 Drawing Sheets

OTHER PUBLICATIONS

Haydock, Stephen, et al., "Diverent sequence motifs correlated with the substrate specificity of (methyl)malonyl-CoA:acyl carrier protein transacylase domains in modular polyketide synthases," *FEBS Letters*, 1995, pp. 246-248, vol. 374. Federation of European Biochemical Societies.

Hopwood, David A., "Genetic Contributions to Understanding Polyketide Synthases," *Chem. Rev.*, 1997, pp. 2465-2498, vol. 97. American Chemical Society.

Ikeda, Harug, et al., "Organization of the biosynthetic gene cluster for the polyketide anthelmintic macrolide avermectin in *Streptomyces avermitilis*," *Proc. Natl. Acad. Sci., USA*, Aug. 1999, pp. 9509-9514, vol. 96.

Kao, Camilla M., et al., "Engineered Biosynthesis of a Triketide Lactone from an Incomplete Modular Polyketide Synthase," *J. Am. Chem. Soc.*, 1994, pp. 11612-11613, vol. 116. American Chemical Society.

Katz, Leonard, "Manipulation of Modular Polyketide Synthases," *Chem. Rev.*, 1997, pp. 2557-2575, vol. 97. American Chemical Society.

Kealey, James T., et al., "Production of a polyketide natural product in nonpolyketide-producing prokaryotic and eurkaryotic hosts," *Proc. Natl. Acad. Sci. USA*, Jan. 1998, pp. 505-509, vol. 95.

Khosla, Chaitan et al., "Generation of polyketide libraries via combinatorial biosynthesis," *Tibtech*, Sep. 1996, pp. 335-341, vol. 14. Elsevier Science Ltd.

Lancelin, Jean-Marc, "Complete Stereostructure of Nystatin $A_1$: A Proton NMR Study," *Tetrahedron Letters*, 1989, pp. 4521-4524, vol. 30, No. 34. Great Britain.

Malpartida, F., et al., "Homology between *Streptomyces* genes coding for synthesis of different polyketides used to clone antibiotic biosynthetic genes," *Nature*, Feb. 26, 1987, pp. 818-821, vol. 325.

McDaniel, Robert et al., "Engineered Biosynthesis of Novel Polyketides," *Science*, Dec. 3, 1993, pp. 1546-1551, vol. 262.

O'Keefe, D.P. et al., "Occurrence and biological function of cytochrome P450 monooxygenases in the actinomycetes," *Molecular Microbiology*, 1991, pp. 2099-2105, vol. 5, No. 9.

Resat, Haluk et al., "Conformational properties of amphotericin B amide derivatives—impact on selective toxicity," *Journal of Computer-Aided Molecular Design*, 2000, pp. 689-703, vol. 14. Kluwer Academic Publishers. The Netherlands.

Schwecke, Torsten et al., "The biosynthetic gene cluster for the polyketide immunosuppressant rapamycin," *Proc. Natl. Acad. Sci. USA*, Aug. 1995, pp. 7839-7843, vol. 92.

Seeger et al., "Putative Transcriptional Regulator", Nov. 1, 1999, Database SWALL ID Q9X9X5, AC Q9X9X5.

Seeger et al., "*Streptomyces* coelicolor cosmid I7," Jul. 1, 1999, Database EM PRO entry ID SCI7 AC AL096743.

Sekurova, Olga, et al., "Molecular cloning and analysis of a pleiotropic regulatory gene locus from the nystati producer *Streptomyces noursei* ATCC11455," *FEMS Microbiology Letters*, 1999, pp. 297-304, vol. 177. Elsevier Science B.V.

Shenin et al., "Nystatin: Methods for preparation, search for derivatives, and prospects for application in medicine," *Khimiko-Farmatsevticheskii Zhurnal*, 1993, pp. 14-21, vol. 27, No. 2.

Tang, Li, Characterization of the enzymatic domains in the modular polyketide synthease involved in rifamycin B biosynthesis by *Amycolatopsis mediterranei*, *Gene*, 1998, pp. 255-265, vol. 216. Elsevier Science B.V.

Vanden Bossche, Hugo, et al., "Anti-*Candida* Drugs—The Biochemical Basis for Their Activity," *CRC Critical Reviews in Microbiology*, 1987, pp. 57-72, vol. 15.

Xue, Yongquan et al., "A gene cluster for macrolide antibiotic biosynthesis in *Streptomyces venezuelae*: Architecture of metabolic diversity," *Proc. Natl. Acad. Sci.*, Oct. 1998, pp. 12111-12116, vol. 95.

Zotchev, Sergey, et al., "Identification of a gene cluster for antibacterial polyketide-derived antibiotic biosynthesis in the nystatin producer *Streptomyces noursei* ATCC 11455," *Microbiology*, 2000, pp. 611-619, vol. 146.

11

13

10

12

GENES ENCODING A NYSTATIN POLYKETIDE SYNTHASE AND THEIR MANIPULATION AND UTILITY

This application is a continuation of U.S. Ser. No. 10/203,295, filed Feb. 7, 2003, which is a 371 filing of PCT/GB01/00509, filed Feb. 8, 2001, which claims priority from United Kingdom Patent Application No. 0002840.7, filed Feb. 8, 2000, United Kingdom Patent Application No. 008786.6, filed Apr. 10, 2000 and United Kingdom Patent Application No. 0009387.2, filed Apr. 14, 2000. The prior applications are incorporated herein by reference.

The present invention relates to the cloning and sequencing of the gene cluster encoding a modular polyketide synthase enzyme involved in the biosynthesis of the macrolide antibiotic nystatin. The invention thus relates to novel genes and nucleic acid molecules encoding proteins/polypeptides exhibiting functional activities involved in nystatin biosynthesis, such functional proteins/polypeptides themselves, and their uses both in facilitating nystatin biosynthesis and in the synthesis of nystatin derivatives and novel polyketide or macrolide structures.

Polyketides are natural products synthesized by microorganisms, many of which have applied potential as pharmaceuticals or as agricultural or veterinary products. Examples of polyketides used in medical treatments include the antibiotics erythromycin (antibacterial), nystatin (antifungal), avermectin (antiparasitic), rapamycin (immunosuppressant) and daunorubicin (antitumor). The Gram-positive bacteria *Streptomyces* are the main producers of polyketides, and the genetics and biochemistry of polyketide biosynthesis in these organisms are relatively well characterized (Hopwood et al., Chem. Rev. v. 97: 2465-2497 (1997)). Macrolide polyketide compounds are formed via repeated condensations of simple carboxylic acids by modular (type I) polyketide synthases (PKS) in a manner similar to fatty acid biosynthesis. The modular hypothesis proposed by Donadio et al. Science, v. 252: 675-679 (1991) suggested that type I PKSs are organized in repeated units (modules), each of which is responsible for one condensation cycle in the synthesis of a polyketide chain. This was proven to be correct by manipulations of PKSs type I genes resulting in predictable changes in the chemical structures of macrolides. Beside condensation of the next carboxylic acid onto the growing polyketide chain, ensured by the catalytic activity of the β-ketoacyl synthase (KS) domain, modules of PKSs type I may contain domains with β-ketoreductase (KR), dehydratase (DH) and enoyl reductase (ER) activities, which determine the reduced state of incorporated extender units. The acyltransferase (AT) and acyl carrier protein (ACP) domains present in each module are responsible for the choice of extender unit and retention of the growing polyketide chain on the PSK, respectively. Upon completion of synthesis, the polyketide chain is released from PKSs via action of a thioesterase (TE), that is probably also involved in cyclization of the final product. Thus, PKSs type I represent an assembly line for polyketide biosynthesis, that can be manipulated by changing the number of modules, their specificities towards carboxylic acids, and by inactivating or inserting domains with reductive activities (Katz, Chem. Rev., v. 97, 2557-2575, 1997). After the polyketide moiety of a macrolide is synthesized and cyclized to form a macrolactone ring, it is usually modified via hydroxylation, glycosylation, methylation and/or acylation. These modifications are believed to be crucially important for the biological activities of macrolides.

The genes for macrolide antibiotic biosynthesis in *Streptomyces* are organized in clusters, and a number of such clusters have already been identified. Exploitation of recombinant DNA technology has made it possible to isolate complete antibiotic biosynthetic gene clusters by screening the gene libraries with DNA probes encoding PKSs (Schwecke et al., Proc. Natl. Acad. Sci. USA, v. 92: 7839-7843, 1995). The molecular cloning and complete DNA sequencing has been described for several macrolide antibiotic gene clusters of *Streptomyces*, including those for avermectin, pikromycin and rapamycin (Ikeda et al., Proc. Natl. Acad. Sci. USA, v. 96: 9509-9514, 1999; Xue et al., Proc. Natl. Acad. Sci. USA, v. 95: 1211-12116, 1998; Schwecke et al., Proc. Natl. Acad. Sci. USA, v. 92: 7839-7843, 1995). Partial cloning and DNA sequencing of the gene cluster for the polyene macrolide antibiotic pimaricin has recently been reported (Aparicio et al., J. Biol. Chem., v. 274: 10133-10139, 1999). However, a complete DNA sequence of genes for the biosynthesis of a polyene macrolide antibiotic with antifungal activity has not yet been disclosed. There is a need and desire to increase the repertoire of available antifungal antibiotics, and/or to improve upon the properties (e.g. efficacy, toxicity, etc.) of existing drugs. Hence the provision of new antifungal treatments, particularly those exhibiting new or improved properties would represent a considerable advance in the art.

The present invention is directed to this aim, and is based on the cloning and DNA sequencing of the nystatin biosynthesis gene cluster. This provides the first example of the identification of such antifungal antibiotic biosynthesis genes, as well as a tool for genetic manipulation in order to modify the properties of nystatin and/or the producing organism, or to obtain novel potentially useful compounds.

The polyene antifungal antibiotic nystatin A1, the complete stereostructure of which (see FIG. 1) has been determined by Lancelin & Beau, Tetrahedron Lett, v. 30: 4521-4524, (1989), is produced by *Streptomyces noursei* ATCC11455. From the structure of the nystatin molecule, which belongs to the class of macrolide compounds, we predicted that its polyketide backbone is synthesized by a PKS type I enzyme. Based on this assumption, and as described in the Examples below, a genomic library of *Streptomyces noursei* ATCC11455 was screened using a specially designed probe obtained by PCR using primers based on conserved amino acid sequences within known β-ketoacyl synthase (KS) and acyl carrier protein (ACP) domains of known modular PKS enzymes. This led to the identification of a number of clones or fragments which we have sequenced and shown to contain parts or portions of the nystatin PKS gene cluster. We have further shown that alteration of the fragment sequences to inactivate the encoded product leads to abrogation of nystatin biosynthesis (see Example 1 below), thereby confirming the requirement of the identified PKS for nystatin biosynthesis. Subsequent work on the clones/fragments has lead to the sequencing of the PKS gene cluster, and the identification of the different modules and enzymatic domains, regulatory regions etc, within it.

Furthermore, as will be described in more detail below, we have shown that manipulations of functional DNA sequences within the novel nystatin PKS gene cluster which we have identified, have led to the synthesis of novel molecular structures, e.g. nystatin derivatives with improved function. This opens up the exciting possibility of manipulating the nystatin A1 PKS gene cluster to obtain not only beneficial new nystatin derivatives, but also to improve and facilitate the biosynthetic production process (for example to improve yield, or production conditions, or to expand the range of available host cells) or to provide novel compounds with new activities and/or properties.

More particularly, two primary regions (or "parts" or "portions") of the nystatin PKS gene cluster were initially identified and sequenced, together representing approximately 80% of the nystatin PKS gene cluster, and the functional sequences within said regions (e.g. PKS genes, regulatory regions etc, as well as functional gene products, enzymatic domains etc.) have been identified and characterised.

The first region ("Region 1"), which we have termed "Nys 1" and the complete DNA sequence of which is shown in SEQ ID No. 1, has been shown to contain a number of PKS or associated genes or regulatory regions, and 13 separate "features" or open reading frames (ORFs) have been identified (the amino acid sequences of the translation products of which are shown in SEQ ID Nos. 3 to 15 respectively).

The second region ("Region 2"), which we have termed "Nys 2", and the complete coding sequence of which is shown in SEQ ID No. 2, also comprises a number of "functional" regions, and 5 separate "features" or ORFs have been identified, the amino acid sequences of the translation products of which are shown in SEQ ID Nos. 16 to 20 respectively.

Nys 1 and Nys 2 (i.e. SEQ ID Nos. 1 and 2 and the sequences they encode) are the subject of British Patent Application No. 0002840.7 filed on 8 Feb. 2000.

Subsequent sequencing efforts have led to the determination of the sequence of the DNA spanning the gap between SEQ ID Nos. 1 and 2, and the identification of novel genes in this region. In addition, the partial gene sequences contained in SEQ ID Nos. 1 and 2 encoding the gene products NysI (SEQ ID No. 20) and NysDII (SEQ ID Nos. 3) (see further below) have been completed (see new SEQ ID Nos. 36 and 37 respectively—see further below). Thus, these sequencing efforts have led to the identification and sequencing of the DNA region encompassing the entire nystatin PKS gene cluster, and the identification and characterisation of the functional sequences within this region.

The complete coding sequence for (i.e. the complete nucleotide sequence encoding) the nystatin biosynthetic gene cluster is shown in SEQ ID No. 35. This has been shown to contain a number of PKS or associated genes or regulatory regions, and 23 separate "features" or ORFs have been identified (the amino acid sequences of the translation products of which are shown in SEQ ID Nos. 2 to 19, and 36 to 42 respectively).

The complete coding sequence for (i.e. the complete nucleotide sequence encoding) the nystatin biosynthetic gene cluster, as shown in SEQ ID No. 35, is the subject of British Patent Application No. 0008786.6 filed on 10 Apr. 2000 and British Patent Application No. 0009387.2 filed on 14 Apr. 2000.

In one aspect, the present invention thus provides a nucleic acid molecule comprising:

(a) a nucleotide sequence as shown in SEQ ID No. 35; or (b) a nucleotide sequence which is the complement of SEQ ID No. 35; or (c) a nucleotide sequence which is degenerate with SEQ ID No. 35; or (d) a nucleotide sequence hybridising under conditions of high stringency to SEQ ID No. 35, to the complement of SEQ ID No. 35, or to a hybridisation probe derived from SEQ ID No. 35 or the complement thereof; or (e) a nucleotide sequence having at least 80% sequence identity with SEQ ID No. 35; or (f) a nucleotide sequence having at least 65% sequence identity with SEQ ID No. 35 wherein said sequence preferably encodes or is complementary to a sequence encoding a nystatin PKS enzyme or a part thereof.

A "nystatin PKS enzyme" is defined further below, but briefly in the context of section (f) above means an enzyme or protein or polypeptide that is functional in the synthesis, transport or transfer of a macrolide antibiotic or polyketide moiety, preferably nystatin or a nystatin derivative or nystatin-related molecule.

In a further aspect, the present invention also provides a nucleic acid molecule comprising:

(a) a nucleotide sequence as shown in SEQ ID No. 1 and/or in SEQ ID No. 2; or (b) a nucleotide sequence which is the complement of SEQ ID No. 1 and/or SEQ ID No. 2; or (c) a nucleotide sequence which is degenerate with SEQ ID No. 1 and/or SEQ ID No. 2; or (d) a nucleotide sequence hybridising under conditions of high stringency to SEQ ID No. 1 and/or SEQ ID No. 2, to the complement of SEQ ID No. 1 and/or SEQ ID No. 2, or to a hybridisation probe derived from SEQ ID Nos. 1 and/or 2 or the complements thereof; or (e) a nucleotide sequence having at least 65% sequence identity with SEQ ID No. 1 and/or SEQ ID No. 2, wherein said sequence preferably encodes or is complementary to a sequence encoding a nystatin PKS enzyme or a part thereof.

A nucleic acid molecule of the invention may be an isolated nucleic acid molecule (in other words isolated or separated from the components with which it is normally found in nature) or it may be a recombinant or a synthetic nucleic acid molecule.

The nucleic acid molecule of the invention encodes (or comprises a nucleotide sequence encoding) the nystatin A1 PKS enzyme, or a portion thereof e.g. a sequence encoding a single domain, or comprises a nucleotide sequence in the nystatin A1 PKS gene cluster which is a functional or non-functional genetic element. More precisely, the nucleic acid molecule of the invention encodes one or more polypeptides, or comprises one or more genetic elements having functional activity in the synthesis of a macrolide antibiotic or a polyketide moiety, preferably nystatin or a nystatin derivative or nystatin-related molecule. Such functional activity may be enzymatic activity e.g. an activity involved in the synthesis or transport or transfer of a polyketide moiety or a macrolide molecule (this can be macrolide chain or ring synthesis or any step contributory thereto, or macrolide ring or polyketide chain modification etc) and/or it may be a regulatory activity, e.g. regulation of the expression of the genes or proteins involved in the synthesis, or regulation of the synthetic process, and/or it may be a "transporter activity". Thus, included generally are also transport proteins involved in the transfer or transport of polyketide or macrolide moieties e.g. in the transport or efflux of the synthesised molecule within or out of the cell. Also included in this respect are glycosylation proteins which includes molecules involved in the biosynthesis and/or attachment of saccharides (e.g. mycosamine) to the macrolide or polyketide.

Whilst nucleotide sequences encoding a desired product are preferred according to the invention, also encompassed are nucleotide sequences comprising functional genetic elements such as promoters, promoter-operator regions, enhancers, other regulatory sequences etc. Thus, the nucleic acid molecule of the invention need not comprise the entire PKS gene cluster but may comprise a portion or part of it e.g. a part encoding a polypeptide having a particular function or a regulatory sequence. This may comprise one or more genes, and/or regulatory sequences, and/or one or more modules or, enzymatic domains, or non-coding or coding functional genetic elements (e.g. elements controlling gene expression, transcription, translation etc).

In one such aspect, the invention provides a nucleic acid molecule as defined above, wherein said nucleotide sequence of SEQ ID No. 35 (or variant thereof as defined in (b) to (f) above) does not include the portions of the molecule comprising ORF 1 (see Table 1 below). In other words, in this embodiment, the nucleotide sequence of SEQ ID No. 35 does not comprise nucleotides 124026 to 125222.

In another such aspect, the invention provides a nucleic acid molecule as defined above, wherein said nucleotide sequence of SEQ ID No. 35 (or variant thereof as defined in (b) to (f) above) does not include the portions of the molecule comprising ORF 2 (see Table 1 below). In other words, in this embodiment, the nucleotide sequence of SEQ ID No. 35 does not comprise nucleotides 122812 to 123876.

In a further such aspect, the invention provides a nucleic acid molecule as defined above, wherein said nucleotide sequence of SEQ ID No. 35 (or variant thereof as defined in (b) to (f) above) does not include the portions of the molecule comprising NysF (see Table 1 below). In other words, in this embodiment, the nucleotide sequence of SEQ ID No. 35 does not comprise nucleotides 454 to 1191.

Alternatively, the invention provides nucleic acid molecules which contain a part of ORF 1, ORF 2 and/or NysF, or a modified sequence of ORF 1, ORF 2 and/or NysF, such that the expression or the function of the ORF 1, ORF 2 and/or NysF gene product is ablated.

Included within the scope of the invention are nucleotide sequences which hybridise to SEQ ID Nos. 1 or 2 or 35 or their complements, or to parts thereof (i.e. to hybridisation probes derived from SEQ ID Nos. 1 or 2 or 35 which are discussed in more detail below), under high stringency conditions and which preferably encode or are complementary to a sequence which encodes a nystatin PKS enzyme or part thereof. Conditions of high stringency may readily be determined according to techniques well known in the art, as described for example in Sambrook et al., 1989, Molecular Cloning, A Laboratory Manual, 2nd Edition. Hybridising sequences included within the scope of the invention are those binding under non-stringent conditions (6×SSC/50% formamide at room temperature) and washed under conditions of high stringency (e.g. 0.1×SSC, 68° C.), where SSC=0.15 M NaCl, 0.015M sodium citrate, pH 7.2.

A hybridisation probe may be a part of the SEQ ID No. 1 or SEQ ID No. 2 or SEQ ID No. 35 sequence (or complementary sequence), which is of sufficient base length and composition to function to hybridise to sample or test nucleic acid sequences to determine whether or not hybridisation under high stringency condition occurs. The probe may thus be at least 15 bases in length preferably at least 30, 40, 50, 75, 100 or 200 bases in length. Representative probe lengths thus include 30-500 bases e.g. 30-300, 50-200, 50-150, 75-100.

The hybridisation probe may be derived from a coding or non-coding, functional or non-functional part of the sequence (i.e. SEQ ID Nos. 1 or 2 or 35 or their complements), and may for example correspond to a gene or module or to an enzymatic domain, or a part thereof (e.g. the part encoding the active site) or to a sequence which links enzymatic domains or modules. Thus, the hybridisation probe may have functional activity in polyketide/macrolide synthesis as defined above.

Nucleotide sequence identity may be determined using the BestFit program of the Genetics Computer Group (GCG) Version 10 Software package from the University of Wisconsin. The program uses the local homology algorithm of Smith and Waterman with the default values: Gap creation penalty=50, Gap extension penalty=3, Average match=10,000, Average mismatch=−9.000.

Nucleotide sequences according to the invention may exhibit at least 65%, 70%, 75%, 80%, 85%, 90%, 95% or 98% sequence identity with SEQ ID Nos. 1 or 2 or 35 and preferably encode or are complementary to a sequence which encodes a nystatin PKS enzyme or part thereof. Nucleotide sequences meeting the % sequence identity criteria defined herein may be regarded as "substantially identical" sequences.

Where the nucleic acid molecules of the invention are defined by reference to SEQ ID Nos. 1 and/or 2, the nucleic acid molecule of the invention may thus comprise a SEQ ID No. 1 or "SEQ ID No. 1-variant" sequence (i.e. a sequence complementary, or degenerate to SEQ ID No. 1 or a functionally equivalent variant such as a hybridising or substantially identical sequence as defined above) or a SEQ ID No. 2 or "SEQ ID NO. 2-variant" sequence or both. Nucleic acid molecules comprising both a SEQ ID No. 1/SEQ ID NO. 1-variant sequence and a SEQ ID No. 2/SEQ ID NO. 2-variant sequence are preferred.

As referred to herein "functionally equivalent variants" or "functional equivalents" retain at least one function of the entity to which they are related (or from which they are derived), e.g. encode a protein with substantially the same properties, or exhibit substantially the same regulatory or other functional properties or activities.

As mentioned above, nucleic acid molecules comprising parts or portions (e.g. fragments) of the nucleotide sequences of SEQ ID No. 35 or of SEQ ID No. 1 and/or 2 (or their complementary, degenerate or functionally equivalent variants) are also included within the scope of the invention.

Such parts or portions of the PKS gene cluster advantageously may also be regarded as functional equivalents of the complete sequence. For example, the sequence portion or fragment may retain a functional activity as defined above, e.g. an enzymatic, regulatory, or transporter activity in polyketide or macrolide biosynthesis.

Conveniently, the part or portion of the PKS gene cluster (e.g. of SEQ ID No. 35, or 1 and/or 2) is at least 15 bases in length, more preferably at least 20, 25, 30, 35, 40, 50, 70, 100, 200, 300, 400, 500, 1000, 2000, 5000, 10,000, 15,000, 20,000, 30,000, or 50,000 bases. Representative fragment lengths thus include 15-50,000 bases e.g. 50-30,000 bases, or 100-20,000, 100-10,000 or 200-5,000, or 200-2,000. The part or portion may comprise or encode contiguous or non-contiguous nucleotide or amino acids.

Parts or portions of functional parts of the PKS gene sequences are discussed in more detail below.

Parts or portions of the PKS gene cluster may also comprise the non-coding or non-functional part of the DNA molecule (or the nucleotide sequences), for example promoter or operator sequences, or linker sequences joining individual genes, modules or enzymatic domains. These may be contiguous or non-contiguous and will be discussed further below.

As mentioned above, a number of genes and ORFS within SEQ ID Nos. 35, 1 and 2 have been identified and such genes (or their complementary, degenerate or functionally equivalent variants as defined above) represent preferred "parts" or fragments of SEQ ID Nos. 35, 1 and 2. These are tabulated in Table 1 below:

TABLE 1

Molecule features of SEQ ID Nos. 35, 1 and 2 (the whole gene cluster sequence (125401 bp) Nys 1 (65140 bp) and Nys 2 (27541 bp) respectively)

SEQ ID No. 35

| Start | End | Gene | Description |
|---|---|---|---|
| 1191 | 454 C | nysF | putative 4'-phsphopantheteine transferase |
| 3092 | 1275 C | nysG | ABC transporter |
| 4824 | 3070 C | nysH | ABC transporter |
| 5122 | 6156 | nysDIII | dGDP-mannose-4,6-dehydratase homolog |
| 6338 | 34771 | nysI | NysI PKS, modules 9-14 |
| 34792 | 51097 | nysJ | NysJ PKS, modules 15-17 |
| 51155 | 57355 | nysK | NysK PKS (module 18 + TE) |
| 57503 | 58685 | nysL | P450 monnoxygenase NysL |
| 58980 | 58788 C | nysM | ferredoxin NysM |
| 60241 | 59047 C | nysN | P450 monooxygenase NysN |
| 61296 | 60240 C | nysDII | putative aminotransferase |
| 62837 | 61317 C | nysDI | putative UDP-glucoronosyltransferase |
| 63067 | 67167 | nysA | NysA PKS, loading module |
| 67213 | 76791 | nysB | NysB PKS, modules 1 and 2 |
| 76811 | 110101 | nysC | NysC PKS, modules 3-8 |
| 110521 | 111276 | nysE | putative thioesterase |
| 111666 | 114566 | nysRI | transcriptional activator |
| 114590 | 117451 | nysRII | putative transcriptional activator |
| 117441 | 120224 | nysRIII | putative transcriptional activator |
| 120676 | 121308 | nysRIV (short) | putative response regulator |
| 120628 | 121308 | nysRIV (long) | putative response regulator |
| 121997 | 122758 | nysRV | putative repressor |
| 123876 | 122812 C | ORF2 | putative transcriptional regulator |
| 124026 | 125222 | ORF1 | putative peptidase (aminohydrolase) |

Note:
"C" indicates that the gene is encoded by the complement DNA strand.

| Start | End | Gene | Description Name |
|---|---|---|---|
| | | | nys 1 (SEQ ID No. 1) |
| 1035 | 3 C | nysD2 | putative aminotransferase |
| 2447 | 1058 C | nysD1 | putative UDP-glucuronosyl-transferase |
| 2806 | 6904 | nysA | nystatin PKS, loading module |
| 6952 | 16528 | nysB | nystatin PKS, modules 1 and 2 |
| 16550 | 49838 | nysC | nystatin PKS, modules 3-8 |
| 50227 | 51013 | nysE | putative thioesterase |
| 51405 | 54303 | nysR1 | putative transcriptional activator 1 |
| 54329 | 57188 | nysR2 | putative transcriptional activator 2 |
| 57180 | 59961 | nysR3 | putative transcriptional regulator 3 |
| 60367 | 61045 | nysR4 | putative response regulator |
| 61736 | 62495 | nysR5 | putative repressor |
| 63615 | 62553 C | ORF2 | putative transcriptional regulator |
| 63765 | 64959 | ORF1 | putative peptidase (aminohydrolase) |
| | | | nys 2 (SEQ ID No. 2) |
| 1191 | 456 C | nysF | putative 4'-phosphopantheteine transferase |
| 3092 | 1277 C | nysG | putative ABC transporter |
| 4824 | 3072 C | nysH | putative ABC transporter |
| 5122 | 6154 | nysD3 | putative GDP-mannose-4,6-dehydratase |
| 6338 | 27541 | nysI | nystatin PKS, modules 9-13 (incomplete) |

"C" in the table above refers to complementary strands.

It will be appreciated that nysD2, D1, A, B, C, E, R1 to R5, ORF1, ORF2 of SEQ ID No. 1 and nysF, G, H and D3, and the partial nysI sequences of SEQ ID No. 2, correspond to their named counterparts in SEQ ID No. 35, which represents the whole complete coding sequence for the gene cluster, and comprises the nucleotide sequences of SEQ ID Nos. 1 and 2. There is however a difference in the nucleotide numbering as between the corresponding features in SEQ ID Nos. 2 and 35; for SEQ ID Nos. 1 and 2, the first nucleotide in the stop codon is recognised as the end of the gene, whereas for SEQ ID No. 35, the third nucleotide of the stop codon is recognised as the end of the gene. nysD1, D2 and D3 are also known as NysDI, DII and DIII, and nysR1 to R5 are also known as nysRI to RV.

As regards SEQ ID No. 1 (nys1) and the gene sequence nysRI, Table 1 shows this to comprise nucleotides 51405 to 54303. Further sequence analysis has revealed however that there are in fact two start codons, nucleotides 51405-51407 encoding GTG and nucleotides 51408-51410 encoding ATG. Accordingly, nucleotide 51408 of SEQ ID No. 1 represents an alternative start nucleotide for nysRI. ATG is preferred as a start codon to GTG, and consequently 51408 is regarded the start nucleotide in future references to nysRI. The start of nysRI in SEQ ID No. 35 is indicated in Table 1 above as the ATG codon, and the translation product of nysRI shown in SEQ ID No. 9 below is deduced from nucleotides 51408-54303 of SEQ ID No. 1. [In an alternative presentation of the NysRI translation product, wherein nucleotide 51405 of SEQ ID No. 1 is the start nucleotide, SEQ ID No. 9 is modified by the inclusion of an additional "first" amino acid, V].

As regards SEQ ID Nos. 35 and 1, and the gene sequence nysRIV, Table 1 shows this to comprise nucleotides 120676 to 121308 in SEQ ID No. 35 (nysRIV short). Further sequence analysis has revealed however that there are in fact two start codons, nucleotides 120676-120678 encoding GTG and nucleotides 120628-120630 encoding GTG. These start codons correspond to start codons in SEQ ID No. 1 for nysR4 at nucleotides 60367-60369 (as stated in Table 1) and 60415-60417. The upstream GTG (120628-120630 in SEQ ID No. 35, which corresponds to 60367-60369 in SEQ ID No. 1) is preferred as a start codon (see Example 6), and consequently 120628 is regarded the start nucleotide in future references to nysRIV. The start of nysRIV in SEQ ID No. 35 is indicated in Table 1 above (nysRIV short) as the downstream start codon 120676-120678, and the deduced translation product of nys-RIV named herein as "NysRIV short" is shown in SEQ ID No. 12. Table 1 also shows the alternative start codon of nysRIV (nysRIV long) in SEQ ID No. 35 as the upstream start codon 120628-120630. Thus a preferred alternative presentation of the NysRIV translation product, named herein "Nys-RIV (long)", is shown in SEQ ID No. 43.

Alternative representative parts of the SEQ ID No. 35, or 1 and/or 2 sequences include the nucleotide sequences between the respective "start" and "end" nucleotide positions, either individually or collectively.

The translation products of the respective "genes" have been deduced and the amino acid sequences are set out in the following SEQ ID Nos. shown below:

| Gene Product | SEQ ID No. |
|---|---|
| NysD2(NysDII) (partial) | 3 |
| NysD1 (nysDI) | 4 |
| NysA | 5 |
| NysB | 6 |
| NysC | 7 |

-continued

| Gene Product | SEQ ID No. |
|---|---|
| NysE | 8 |
| NysR1(NysRI) | 9 |
| NysR2(NysRII) | 10 |
| NysR3(NysRIII) | 11 |
| NysR4(NysRIV) (short) | 12 |
| NysR4(NysRIV) (long) | 43 |
| NysR5(NysRV) | 13 |
| ORF2 | 14 |
| ORF1 | 15 |
| NysF | 16 |
| NysG | 17 |
| NysH | 18 |
| NysD3(NysDIII) | 19 |
| NysI | 20 |
| NysDII(complete) | 36 |
| NysI(complete) | 37 |
| NysJ | 38 |
| NysK | 39 |
| NysL | 40 |
| NysM | 41 |
| NysN | 42 |

SEQ ID Nos. 4, 10, 12, 13, 14, 16, 18, 41 and 43 show valine (V) as the first amino acid. According to practice in this field and conceptual translation of bacterial DNA, the first amino acid of a protein (translation product) is always methionine (M), regardless of the start codon. Accordingly, translation products and amino acid sequences of the present invention include not only SEQ ID Nos. 4, 10, 12, 13, 14, 16, 18, 41 and 43 as presented but also modifications of the aforesaid sequences in which the first V is replaced with M. References to SEQ ID Nos. 4, 10, 12, 13, 14, 16, 18, 41 and 43 below will be understood to include not only the sequences as presented, but also the said sequences wherein the first V is replaced with M.

Viewed from an alternative aspect, the present invention also provides a nucleic acid molecule comprising a nucleotide sequence encoding one or more amino acid sequences selected from SEQ ID Nos 3 to 20 or 36 to 43, or a nucleotide sequence which is complementary thereto or degenerate therewith.

Also provided are nucleic acid molecules comprising nucleotide sequences encoding one or more amino acid sequences (i.e. polypeptides) which exhibit at least 60% sequence identity with any one of SEQ ID Nos. 3 to 20 or 36 to 43.

A further aspect of the invention provides a polypeptide encoded by a nucleic acid molecule of the invention as defined herein.

More particularly, this aspect of the invention provides a polypeptide comprising:

(a) all or part of an amino acid sequence as shown in any one or more of SEQ ID Nos. 3 to 20 or 36 to 43; or (b) all or part of an amino acid sequence which has at least 60% sequence identity with any one or more of SEQ ID Nos. 3 to 20 or 36 to 43.

In particular the amino acid sequence may exhibit at least 60%, 65%, 70%, 75%, 80%, 85%, 90%, 95% or 98% identity with the polypeptide of any one of SEQ ID Nos. 3 to 20 or 36 to 43. Alternatively, the amino acid sequence may exhibit at least 70%, 75%, 80%, 85%, 90%, 95% or 98% similarity with the polypeptide of any one of SEQ ID Nos. 3 to 20 or 36 to 43. Amino acid (polypeptide) sequences meeting the % sequence identity or similarity criteria herein are regarded as "substantially identical". The polypeptide of the invention may be an isolated, purified or synthesized polypeptide. The term "polypeptide" is used herein to include any amino acid sequence of two or more amino acids i.e. both short peptides and longer lengths (i.e. polypeptides) are included.

Amino acid sequence identity or similarity may be determined using the BestFit program of the Genetics Computer Group (GCG) Version 10 Software package from the University of Wisconsin. The program uses the local homology algorithm of Smith and Waterman with the default values: Gap creation penalty=8, Gap extension penalty=2, Average match=2.912, Average mismatch=−2.003.

A "part" of the amino acid sequence of any one of SEQ ID Nos. 3 to 20 or 36 to 43 (or of a "substantially identical" sequence as defined above) may comprise at least 20 contiguous amino acids, preferably at least 30, 40, 50, 70, 100, 150, 200, 300, 400, 500, 1,000, 2,000, 5,000 or 10,000 contiguous amino acids.

The polypeptide, and preferably also the part thereof, is functionally active according to the definitions given above, e.g. is enzymatically active or has a regulatory or transport functional activity. The part may not itself be functionally active but may in some instances provide regions with functional properties of the whole, e.g. represent the active site or co-factor binding site required for enzymatic activity.

The studies described in the Examples below have characterised the nucleotide and polypeptide sequences of the invention and various functional regions within them have been identified. Such functional regions form separate aspects of the invention. For the various translation products (i.e. gene products of SEQ ID Nos. 3 to 20 or 36 to 43), these functional regions are summarised below in Table 2 below:

TABLE 2

Molecule Features of Translation Products of
SEQ ID Nos. 3 to 20 and 36 to 43

(i) SEQ ID No.: 5
Translation Product Name: NysA

| Start AA | End AA | Name | Description |
|---|---|---|---|
| 8 | 430 | $KS^s$ | KS domain, loading module |
| 528 | 841 | AT | AT domain, loading module |
| 855 | 1055 | DH | DH domain, loading module |
| 1285 | 1359 | ACP | ACP domain, loading module |

| Start | End | Name | Description |
|---|---|---|---|

(ii) SEQ ID No.: 6
Translation Product Name: NysB

| 42 | 462 | KS1 | KS domain, module 1 |
|---|---|---|---|
| 578 | 897 | AT1 | AT domain, module 1 (mMCoA-specific) |
| 911 | 1110 | DH1 | DH domain, module 1 (inactive) |
| 1201 | 1447 | KR1 | KR domain, module 1 |
| 1484 | 1559 | ACP1 | ACP domain, module 1 |
| 1579 | 2004 | KS2 | KS domain, module 2 |
| 2117 | 2439 | AT2 | AT domain, module 2 (mMCoA-specific) |
| 2453 | 2659 | DH2 | DH domain, module 2 (inactive) |
| 2749 | 2996 | KR2 | KR domain, module 2 |
| 3025 | 3102 | ACP2 | ACP domain, module 2 |

(iii) SEQ ID No.: 7
Translation Product Name: NysC

| 35 | 455 | KS3 | KS domain, module 3 |
|---|---|---|---|
| 546 | 858 | AT3 | AT domain, module 3 |
| 872 | 1073 | DH3 | DH domain, module 3 |
| 1381 | 1628 | KR3 | KR domain, module 3 |
| 1662 | 1735 | ACP3 | ACP domain, module 3 |

TABLE 2-continued

Molecule Features of Translation Products of SEQ ID Nos. 3 to 20 and 36 to 43

| | | | |
|---|---|---|---|
| 1757 | 2180 | KS4 | KS domain, module 4 |
| 2291 | 2603 | AT4 | AT domain, module 4 |
| 2617 | 2818 | DH4 | DH domain, module 4 |
| 3124 | 3371 | KR4 | KR domain, module 4 |
| 3407 | 3480 | ACP4 | ACP domain, module 4 |
| 3501 | 3924 | KS5 | KS domain, module 5 |
| 4032 | 4346 | AT5 | AT domain, module 5 |
| 4360 | 4561 | DH5 | DH domain, module 5 |
| 4953 | 5239 | ER5 | ER domain, module 5 |
| 5248 | 5495 | KR5 | KR domain, module 5 |
| 5528 | 5601 | ACP5 | ACP domain, module 5 |
| 5623 | 6046 | KS6 | KS domain, module 6 |
| 6166 | 6478 | AT6 | AT domain, module 6 |
| 6492 | 6704 | DH6 | DH domain, module 6 |
| 7038 | 7281 | KR6 | KR domain, module 6 |
| 7315 | 7388 | ACP6 | ACP domain, module 6 |
| 7408 | 7831 | KS7 | KS domain, module 7 |
| 7939 | 8253 | AT7 | AT domain, module 7 |
| 8267 | 8470 | DH7 | DH domain, module 7 |
| 8812 | 9086 | KR7 | KR domain, module 7 |
| 9120 | 9193 | ACP7 | ACP domain, module 7 |
| 9214 | 9637 | KS8 | KS domain, module 8 |
| 9758 | 10072 | AT8 | AT domain, module 8 |
| 10086 | 10289 | DH8 | DH domain, module 8 |
| 10657 | 10904 | KR8 | KR domain, module 8 |
| 10939 | 11012 | ACP8 | ACP domain, module 8 |

(iv) SEQ ID No.: 9
Translation Product Name: Nys R1

| | | | |
|---|---|---|---|
| 42 | 49 | P-loop | ATP/GTP binding site motif A |
| 904 | 932 | HTH | LuxR-type helix-turn-helix motif (DNA binding) |

(N.B. In the alternative representation of NysR1 above, where nt 51405 of SEQ ID No. 1 is regarded as the start codon, these start and amino acid end numbers would each increase by 1.)

(v) SEQ ID No.: 10
Translation Product Name: NysR2

| | | | |
|---|---|---|---|
| 902 | 930 | HTH | LuxR-type helix-turn-helix motif (DNA binding) |

(vi) SEQ ID No.: 11
Translation Product Name: NysR3

| | | | |
|---|---|---|---|
| 26 | 47 | LZ | Leucine zipper motif (DNA binding) |
| 548 | 568 | TM1 | Transmembrane domain (putative) |
| 583 | 610 | TM2 | Transmembrane domain (putative) |
| 884 | 912 | HTH | LuxR helix-turn-helix motif |

(vii) SEQ ID No.: 12
Translation Product Name: NysR4 (short)

| | | | |
|---|---|---|---|
| 97 | 104 | P-loop | ATP/GTP binding site motif A |
| 149 | 177 | HTH | LuxR helix-turn-helix motif (DNA binding) |

(viii) SEQ ID No.: 13
Translation Product Name: NysR5

| | | | |
|---|---|---|---|
| 6 | 40 | HTH | DeoR helix-turn-helix motif (DNA binding) |

(ix) SEQ ID No.: 14
Translation Product Name: ORF2

| | | | |
|---|---|---|---|
| 186 | 202 | HTH | AsnC HTH motif signature |

(x) SEQ ID No.: 17
Translation Product Name: NysG

| | | | |
|---|---|---|---|
| 31 | 313 | TM | Transmembrane regions |
| 392 | 399 | P-loop | ATP/GTP binding site |
| 496 | 510 | ABC | ABC transporters signature |

(xi) SEQ ID No.: 18
Translation Product Name: NysH

| | | | |
|---|---|---|---|
| 17 | 288 | TM | Transmembrane regions |
| 368 | 375 | P-loop | ATP/GTP binding motif A |
| 472 | 486 | ABC | ABC transporters signature |

(xii) SEQ ID No.: 20
Translation Product Name: NysI (partial)

| | | | |
|---|---|---|---|
| 34 | 448 | KS9 | KS domain, module 9 |
| 572 | 890 | AT9 | AT domain, module 9 |
| 904 | 1123 | DH9 | DH domain, module 9 |
| 1443 | 1686 | KR9 | KR domain, module 9 |
| 1720 | 1793 | ACP9 | ACP domain, module 9 |
| 1813 | 2236 | KS10 | KS domain, module 10 |
| 2346 | 2664 | AT10 | AT domain, module 10 |
| 2678 | 2890 | DH10 | DH domain (inactive), module 10 |
| 2983 | 3229 | KR10 | KR domain, module 10 |
| 3266 | 3339 | ACP10 | ACP domain, module 10 |
| 3358 | 3780 | KS11 | KS domain, module 11 |
| 3898 | 4217 | AT11 | AT domain, module 11 (mMCoA-specific) |
| 4231 | 4432 | DH11 | DH domain (inactive), module 11 |
| 4523 | 4770 | KR11 | KR domain, module 11 |
| 4806 | 4879 | ACP11 | ACP domain, module 11 |
| 4801 | 5325 | KS12 | KS domain, module 12 |
| 5432 | 5754 | AT12 | AT domain, module 12 |
| 5768 | 5977 | DH12 | DH domain (inactive), module 12 |
| 6068 | 6315 | KR12 | KR domain, module 12 |
| 6348 | 6421 | ACP12 | ACP domain, module 12 |
| 6454 | 6873 | KS13 | KS domain, module 13 |

(xiii) SEQ ID No.: 37
Translation Product Name: NysI

| | | | |
|---|---|---|---|
| 34 | 448 | KS9 | KS domain, module 9 |
| 572 | 890 | AT9 | AT domain, module 9 |
| 904 | 1123 | DH9 | DH domain, module 9 |
| 1443 | 1686 | KR9 | KR domain, module 9 |
| 1720 | 1793 | ACP9 | ACP domain, module 9 |
| 1813 | 2236 | KS10 | KS domain, module 10 |
| 2346 | 2664 | AT10 | AT domain, module 10 |
| 2678 | 2890 | DH10 | inactive DH domain, module 10 |
| 2983 | 3229 | KR10 | KR domain, module 10 |
| 3266 | 3336 | ACP10 | ACP domain, module 10 |
| 3355 | 3777 | KS11 | KS domain, module 11 |
| 3898 | 4217 | AT11 | AT domain (methylmalony-CoA-specific), module 11 |
| 4231 | 4432 | DH11 | inactive DH domain, module 11 |
| 4523 | 4769 | KR11 | KR domain, module 11 |
| 4806 | 4879 | ACP11 | ACP domain, module 11 |
| 4901 | 5325 | KS12 | KS domain, module 12 |
| 5432 | 5754 | AT12 | AT domain, module 12 |
| 5768 | 5977 | DH12 | inactive DH domain, module 12 |
| 6068 | 6315 | KR12 | KR domain, module 12 |
| 6348 | 6421 | ACP12 | ACP domain, module 12 |
| 6454 | 6873 | KS13 | KS domain, module 13 |
| 6973 | 7293 | AT13 | AT domain, module 13 |
| 7307 | 7448 | DH13 | inactive DH domain, module 13 |
| 7535 | 7774 | KR13 | inactive KR domain, module 13 |
| 7813 | 7886 | ACP13 | ACP domain, module 13 |
| 7908 | 8323 | KS14 | KS domain, module 14 |
| 8430 | 8741 | AT14 | AT domain, module 14 |
| 8755 | 8962 | DH14 | inactive DH domain, module 14 |
| 9050 | 9296 | KR14 | KR domain, module 14 |
| 9319 | 9394 | ACP14 | ACP domain, module 14 |

(xiii) SEQ ID No.: 38
Translation Product Name: NysJ

| | | | |
|---|---|---|---|
| 41 | 464 | KS15 | KS domain, module 15 |
| 578 | 889 | AT15 | AT domain, module 15 |
| 903 | 1102 | DH15 | DH domain, module 15 |
| 1446 | 1731 | ER15 | ER domain, module 15 |
| 1740 | 1988 | KR15 | KR domain, module 15 |
| 2023 | 2096 | ACP15 | ACP domain, module 15 |
| 2117 | 2538 | KS16 | KS domain, module 16 |
| 2635 | 2953 | AT16 | AT domain, module 16 |
| 2967 | 3167 | DH16 | inactive DH domain, module 16 |
| 3257 | 3500 | KR16 | KR domain, module 16 |
| 3539 | 3612 | ACP16 | ACP domain, module 16 |
| 3634 | 4057 | KS17 | KS domain, module 17 |
| 4153 | 4472 | AT17 | AT domain, module 17 |
| 4486 | 4725 | DH17 | inactive DH domain, module 17 |

TABLE 2-continued

Molecule Features of Translation Products of
SEQ ID Nos. 3 to 20 and 36 to 43

| 4997 | 5245 | KR17 | KR domain, module 17 |
| 5277 | 5350 | ACP17 | ACP domain, module 17 |

(xiii) SEQ ID No.: 39
Translation Product Name: NysK

| 34 | 457 | KS18 | KS domain, module 18 |
| 568 | 881 | AT18 | AT domain, module 18 |
| 898 | 1102 | DH18 | inactive DH domain, module 18 |
| 1416 | 1663 | KR18 | KR domain, module 18 |
| 1695 | 1769 | ACP18 | ACP domain, module 18 |
| 1849 | 2066 | TE | thioesterase domain |

(xiv) SEQ ID No.: 43
Translation Product Name: NysRIV (long)

| 31 | 85 | PAS | PAS-like domain |
| 113 | 120 | P-loop | ATP/GTP binding site motif A |
| 165 | 193 | HTH | LuxR helix-turn-helix motif (DNA binding) |

As referred to in the above "inactive" denotes DH domains which lack the conserved amino acid sequence representing the active site motif $H(X_3)G(X_4)P$ found in DH in other PKSs. It will however be appreciated that these domains may have activity although this is likely to be distinct from the activity of DH domains in other PKSs.

It will be seen that SEQ ID Nos. 5 (NysA), 6 (NysB), 7 (NysC), 20 and 37 (NysI), 38 (NysJ) and 39 (NysK) constitute actual "PKS" enzymes, namely enzymes involved in polyketide synthesis. These gene products contain identifiable enzymatic domains and modules which are tabulated in Table 2 above and shown also in FIGS. 4, 8 and 9 (see also Example 1 and Table 4, and Example 4 below which describes the DNA sequence analysis of nystatin biosynthesis gene cluster in more detail). Such individual domains and molecules, as identified herein form separate aspects of the present invention.

SEQ ID NOs 3 and 26 (NysDII), 4 (NysDI), 8 (NysE), 16 (NysF), 19 (NysDIII), 40 (NysL), 41 (NysM) and 42 (NysN) represent other enzymes functional in polyketide or macrolide synthesis e.g. in polyketide release from PKS, post-translational PKS modification, and polyketide modification. SEQ ID NOs 10 to 15 and 43 (NysRI to NysRV, and ORF2) respectively represent transcriptional regulators, and SEQ ID NOs 17 and 18 (NysG and NysH) represent transport proteins which are presumed to be involved in polyketide transport from the cell. This is also described in more detail in the Examples below. Such functional proteins represent separate aspects of the present invention. Also included are functional parts or fragments of such proteins i.e. active parts or fragments which retain (i.e. exhibit measurable levels of) the biological activity of the parent molecule from which they are derived (i.e. of the whole protein or polypeptide).

The nucleotide sequences of the present invention provide important tools and information which can be utilised in a number of ways to manipulate nystatin biosynthesis, to synthesise new nystatin derivatives or novel polyketide or macrolide structures, and to provide novel or modified PKS systems (by "PKS system" here is meant a polyketide synthesis system i.e. a gene cluster or protein complex, collection or assembly, which is functional in polyketide synthesis, but which is not necessarily restricted to PKS enzymes or enzymatic domains, and which may contain also other functional activities, e.g. other enzymatic (e.g. modificatory) or transporter or regulatory functional proteins).

Thus, for example, the entire nystatin PKS gene cluster or PKS synthetic system as provided herein, or a portion thereof, may be subjected to modification so as to modify one or more genes, or one or more modules, or enzymatic domains, or functional sequences within it. Such modified or derivatised PKS systems may be used to synthesize novel or modified polyketide moieties, as will be described in more detail below. In this situation, the nystatin PKS system provided herein, or a fragment or portion thereof, may function as an "origin" or "template" or "source" system or sequence for modification.

More particularly, in one such embodiment and as further described below, the non-functional parts (e.g. non-biologically active parts) of said system may be utilised as a "scaffold", and the functional parts (e.g. sequences encoding enzymatic portions) may be modified to yield the derivative or modified PKS system. In some embodiments only a single selected, or few selected functional (e.g. enzymatic) regions may be modified, leaving the remaining sequence or structure largely intact.

Alternatively, the functional portions may be utilised as tools or materials for the modification of other "scaffold" structures e.g. individual nystatin genes, modules or domains may be used for introduction (e.g. insertion or replacement) into other PKS scaffold structures e.g. PKS scaffold systems derived from PKS systems for other macrolide antibiotics e.g. erythromycin, rapamycin etc.

Included within the scope of the invention are synthetic or recombinant polyketide synthase enzymes derived from the scaffold encoded by the nystatin gene cluster which are modified to include one or more functional units derived from other modular enzymes. Such functional units may encode a catalytic or transport protein domain for example a ketoreductase domain from a PKS enzyme or an ACP domain from a modular hybrid polyketide/peptide synthesising enzyme. Such domains can be derived from enzyme domain DNA sequences from, for example, polyketide synthesising enzymes, peptide synthesising enzymes, hybrid peptide polyketide synthesising enzymes, fatty acid synthesising enzymes or other enzyme domains known in the art. Analogously, there are included within the scope of the invention, synthetic or recombinant polyketide synthase enzymes derived from the scaffold encoded by a different polyketide synthase gene cluster, or modular enzyme encoding gene cluster, which are modified to include one or more functional units derived from the nystatin gene cluster.

Thus, the sequence and activity information provided here for the nystatin biosynthesis gene cluster may be used to alter existing known gene clusters and hence the products they produce. In particular, selection and incorporation of particular domains described herein (or modification of existing sequences) into existing PKS gene clusters will allow incorporation of particular properties attributable to the nystatin gene cluster.

Thus, in a very general sense, the present invention provides the use of the nucleic acid molecules of the invention as defined herein in the preparation of a modified PKS system, or in the preparation of modified polyketide molecules.

Such novel or modified polyketide or macrolide molecules form a separate aspect of the present invention.

The nucleotide sequences may be utilised in this way according to the present invention in a random or directed or designed manner, e.g. to obtain and test a particular predetermined or pre-designed structure, or to create random molecules, for example libraries of polyketide structures, e.g. for screening (this is also described in more detail below).

Whether for modification within the nystatin-PKS scaffold, or for introduction into an alternative scaffold structure, the genes or genetic elements which can be modified include not only the actual PKS genes (which encode NysA, NysB, NysC, NysI, NysJ and NysK) or the individual molecules or domains thereof, but also genes encoding other enzymes or functional proteins involved in nystatin biosynthesis and transport (referred to herein collectively as "PKS genes" or "nystatin genes").

As regards the actual PKS genes, as will be described in more detail below, these may be modified to change the nature of the loading domain molecule which determines the nature of the starter unit, the number of modules, the nature of the extender, as well as the various dehydratase, reductase and synthase activities which determine the structure of the polyketide chain.

Other genes which can be modified include the thioesterase gene, (encoding NysE; SEQ ID NO. 8), which may be modified to increase the efficiency of the PKS system (in the case of a thioesterase having "editing" activity which clears the inappropriate substrates from the PKS). If the thioesterase simply cleaves the final product off the PKS, it can be used for making nystatin derivatives with a smaller macrolactone ring by truncating nystatin PKS, and fusing this thioesterase to the end of the truncated protein via genetic engineering.

Regulatory genes: activators can be overexpressed and repressors inactivated in order to boost polyketide or antibiotic production. This may be of particular importance for the production of new nystatin derivatives in recombinant strains, (which may be produced in very small quantities).

The putative 4'-phosphopantetheine (PPT) transferase gene (encoding NysF; SEQ ID NO: 16) can be overexpressed in order to achieve efficient post-translational modification and full functionality of the PKS. It can also be used for expression of the nystatin (or other) PKS in a heterologous host, which lacks the specific PPT activity. Such hosts may include E. coli, Saccharomyces cereviseae, etc.

Deoxysugar genes: glycosyltransferase (encoding NysDI; SEQ ID NO:4) can be overexpressed in order to boost glycosylation of the synthesised molecules e.g. novel nystatin derivatives. It can also be modified by in vitro mutagenesis in order to increase its specificity towards the new substrates. Inactivation of this glycosylstranferase will result in a recombinant strain producing non-glycosylated nystatin (probably also lacking some modifications) which can be used, for example, for chemical modifications, or enzymatic assays for screening new modification activities.

Aminotransferase (NysDII; SEQ ID Nos: 3 and 36) may be inactivated to give a nystatin derivative. This enzyme is presumed to attach the amino group on the deoxysugar mycosamine. This gene may also be expressed in other streptomycetes in order to achieve the same reaction with another deoxysugar normally lacking an amino group.

ABC transporters (e.g. NysH and NysG; SEQ ID NOs 17 and 18): can be overexpressed in order to make the efflux of nystatin and its derivatives more efficient. They may also be mutated in order to shift their specificity towards different compounds. They may be inactivated, if it is desired for any reason to accumulate the nystatin or its derivatives inside the cell.

The genes encoding monooxygenases NysL and NysN (SEQ ID Nos. 40 and 42) can be inactivated in S. noursei in order to obtain non-hydroxylated and non-oxidized nystatin derivatives. Alternatively, they can be mutated with the aim of changing their specificities toward nystatin precursors. Overexpression of nysL and nysN may potentially lead to increased yield of nystatin or its derivatives if the hydroxylation and/or oxidation steps are limiting in the nystatin biosynthetic pathway. Genetic manipulations with nysM encoding ferredoxin (SEQ ID No.41) might also be useful if one wishes to establish an in vitro P450 hydroxylase system for modifications of nystatin precursors.

Thus, in addition to modification of the nystatin PKS system, or modification of other PKS systems by using the "nystatin" genes, the nucleic acid molecules of the invention can also be utilised to manipulate or facilitate the biosynthetic process, for example by extending the host range or increasing yield or production efficiency etc.

In order to enable practice of the invention according to the principles above, the invention also provides an expression vector, and host cells containing a nucleic acid molecule as herein defined.

Also provided are methods for production of a polyketide or macrolide molecule (e.g. nystatin or a nystatin derivative), comprising expressing within a host cell, a nucleic acid molecule as defined above. The polyketide or macrolide molecule produced within the host cell or secreted or exported by the host-cell as a result of expression of the nucleic acid molecule (i.e. expression of the introduced "PKS synthesis machinery") may then be recovered.

This method of the invention may thus involve growing or cultivating the host cell under conditions whereby the nucleic acid molecule is expressed, and allowing the expression product(s) of the nucleic acid molecule to synthesise the polyketide/macrolide molecule, or in other words, growing or cultivating the host cell under conditions wherein the polyketide or macrolide is produced.

Also provided are methods for preparing recombinant nucleic acid molecules according to the invention, comprising inserting the nucleic acid molecules containing the nucleotide sequences of the invention into another nucleic acid molecule, e.g. into vector nucleic acid, e.g. vector DNA.

Expression vectors of the invention may include appropriate control sequences such as for example translational (e.g. start and stop codons, ribosomal binding sites) and transcriptional control elements (e.g. promoter-operator regions, termination stop sequences) linked in matching reading frame with the nucleic acid molecules of the invention.

Vectors according to the invention may include plasmids and viruses (including both bacteriophage and eukaryotic viruses) according to techniques well known and documented in the art, and may be expressed in a variety of different expression systems, also well known and documented in the art.

A variety of techniques are known and may be used to introduce such vectors into prokaryotic or eukaryotic cells for expression, or into germ line or somatic cells to form transgenic animals. Suitable transformation or transfection techniques are well described in the literature.

The invention also includes transformed or transfected prokaryotic or eukaryotic host cells, for transgenic organisms containing a nucleic acid molecule according to the invention as defined above. Such host cells may for example include prokaryotic cells such as E. coli, Streptomyces and other bacteria, eukaryotic cells such as yeasts or the baculovirus-insect cell system, transformed mammalian cells and transgenic animals and plants.

The nucleic acid molecules contained in the expression vectors, and host cells and organisms etc. above may also be, as will be described in more detail below, derivative nucleic acid molecules, derived from the nucleic acid molecules defined above, either by modification or by introducing said molecules or parts thereof into, or combining with, other nucleic acid molecules.

Thus, in one aspect, the invention provides recombinant materials for the production of combinatorial libraries of polyketides wherein the polyketide members of the library are synthesized by modified PKS systems derived from the naturally occurring nystatin A1 system provided herein by using this system as a scaffold. Generally, many members of these libraries may themselves be novel compounds, and the invention further includes novel polyketide members of these libraries. The invention methods may thus be directed to the preparation of an individual polyketide. The polyketide may or may not be novel, but the method of preparation permits a more convenient method of preparing it. The resulting polyketides may be further modified to convert them to antibiotics, typically through glycosylation. The invention also includes methods to recover novel polyketides with desired binding activities by screening the libraries of the invention.

Thus, in one aspect, the invention is directed to a method of preparing a nucleic acid molecule which contains or comprises a nucleotide sequence encoding a modified polyketide synthase enzyme or enzyme system. The method comprises using the nystatin PKS encoding sequence as provided herein as a scaffold and modifying the portions of the nucleotide sequence that encode enzymatic or other functional activities e.g. by mutagenesis, inactivation (e.g. by deletion or insertion), or replacement. The thus modified nucleotide sequence encoding a modified PKS can then be used to modify a suitable host cell and the cell thus modified employed to produce a polyketide different from that produced by the native nystatin PKS, whose scaffolding has been used to support modifications of enzymatic activity.

Alternatively, one or more portions of the nucleotide sequence that encode enzymatic or other functional activities may be introduced into an alternative (i.e. different "second") PKS scaffold (i.e. a scaffold derived from a further "second" PKS system, different from the nystatin PKS system).

The invention is also directed to polyketides thus produced and the antibiotics to which they may then be converted.

In another aspect, the invention is directed to a multiplicity of cell colonies comprising a library of colonies wherein each colony of the library contains an expression vector for the production of a different modular PKS, but derived from the nystatin PKS of the invention, as defined above. The library of different modular PKS may be obtained by modifying one or more of the regions of a naturally occurring "nystatin" gene or gene cluster encoding an enzymatic activity so as to alter that activity, leaving intact the scaffold portions of the naturally occurring gene.

In another aspect, the invention is directed to a multiplicity of cell colonies comprising a library of colonies wherein each colony of the library contains a different modular PKS derived from the nystatin PKS of the invention. The invention is also directed to methods to produce libraries of PKS complexes and to produce libraries of polyketides by culturing these colonies, as well as to the libraries so produced. In addition, the invention is directed to methods to screen the resulting polyketide libraries and to novel polyketides contained therein.

As mentioned above, a structural and functional sequence analysis of the nystatin PKS gene cluster/system is presented in the Examples below and the DNA sequences are shown in SEQ ID NO 1, 2 and 35, and further analysed in Tables 1 and 2 above, SEQ ID NOs 3 to 20, and 36 to 42 and in FIGS. 2, 3, 7, 8 and 9. The modular and "domain" encoding structure of the "PKS" gene may be seen. A module may typically contain a ketosynthase (KS), an acyltransferase (AT) and an acyl carrier protein (ACP). These three functions are sufficient to activate an extender unit and attach it to the remainder of the growing molecule. Additional activities that may be included in a module relate to reactions other than the Claisen condensation, and include a dehydratase activity (DH), an enoylreductase activity (ER) and a ketoreductase activity (KR). The loading module catalyses the initial condensation, i.e. it begins with a "loading domain" represented by AT and ACP, which determine the nature of the starter unit. The "finishing" of the molecule is believed to be regulated by thioesterase activity (TE) and it is believed that this is achieved by the TE activity embedded in NysK. This thioesterase appears to catalyse cyclization of the macrolide ring thereby increasing the yield of the polyketide product. The NysE TE activity is believed to be an "editing" one, and participates in cleaving off certain substrates from the nystatin PKS complex.

It will be seen from the sequences, Figures and Tables above and below, that the regions in the genes and modules that encode enzymatic activities are separated by linker or "scaffold"-encoding regions. These scaffold regions encode amino acid sequences that space the enzymatic/functional activities at the appropriate distances and in the correct order. Thus, these linker regions collectively can be considered to encode a "scaffold" into which the various activities are placed in a particular order and spatial arrangement. It should however be noted that in some instances regions of the scaffold may be deleted or modified without significantly affecting the activity of the resultant PKS. Indeed the sequence encoding some domains with functional activity may be fully or partially deleted without significant effects. Thus as used herein "scaffold" refers to portions of PKS cluster not directly attributable to functional e.g. enzymatic activities of said PKS, but responsible for maintenance of its overall activity, e.g. providing correct spatial orientation or structure. Said scaffold may comprise all linker and non-functional regions of the PKS or a functionally active (i.e. retaining structural integrity) part thereof. This organization is similar in other naturally occurring modular PKS gene clusters.

The invention provides libraries or individual modified forms, ultimately of polyketides, by generating modifications in the nystatin PKS gene cluster so that the protein complexes produced by the cluster have altered activities in one or more respects, and thus produce polyketides other than the natural product of the PKS (i.e. nystatin A1). Novel polyketides may thus be prepared, or polyketides in general prepared more readily, using this method. By providing a large number of different genes or gene clusters derived from the naturally occurring nystatin PKS gene cluster, each of which has been modified in a different way from the native cluster, an effectively combinatorial library of polyketides can be produced as a result of the multiple variations in these activities. Alternatively the nystatin PKS "functional regions" (e.g. genes, modules or domains) may be used, for introduction into a "scaffold" obtained from another naturally occurring PKS system. The modified PKS encoding sequences and systems used in the present invention thus represent modular polyketide synthases "derived from" a naturally occurring nystatin PKS.

By a modular PKS "derived from" the nystatin PKS is meant a modular polyketide synthase (or its corresponding encoding gene(s)) that retains the scaffolding of all of the utilized portion of the naturally occurring gene. (Not all modules or genes need be included in the constructs). On the constant scaffold, at least one enzymatic or functional activity is mutated, deleted or replaced, so as to alter the activity. Alteration results when these activities are deleted or are replaced by a different version of the activity, or simply mutated in such a way that a polyketide other than the natural product results from these collective activities. This occurs because there has been a resulting alteration of the starter unit and/or extender unit, and/or stereochemistry, and/or chain length or cyclization and/or reductive or dehydration cycle outcome at a corresponding position in the product polyketide. Where a deleted activity is replaced, the origin of the replacement activity may come from a corresponding activity in a different naturally occurring polyketide synthase or from a different region of the same PKS. Alternatively, such a "derived" modular PKS may incorporate one or more enzymatic or other functional activities (or their encoding nucleotide sequences) obtained or derived from the nystatin PKS described herein, in the scaffolding of a second, different modular PKS (or its gene).

Modification or manipulation of the modular PKS may involve truncation, e.g. gene or domain or module deletion or domain/gene/module swapping, addition or inactivation, which may involve insertion or deletion. Alternatively, random or directed modifications (i.e. mutations) may be made in the nucleotide sequence of the selected portion (e.g. in a gene/domain/module etc).

The derivative may contain preferably at least a thioesterase activity from the nystatin PKS gene cluster.

Advantageously, a polyketide synthase "derived from" the nystatin PKS may contain the scaffolding encoded by all or the portion employed of the nystatin synthase gene, contains at least two modules that are functional, preferably four or more modules and contains mutations, deletions, or replacements of one or more of the activities of these functional modules so that the nature of the resulting polyketide is altered. This definition applies both at the protein and genetic levels. Particular preferred embodiments include those wherein a KS, AT, KR, DH or ER has been inactivated or deleted or replaced by a version of the activity from a different PKS or from another location within the same PKS. Also preferred are derivatives where at least one noncondensation cycle enzymatic activity (KR, DH or ER) has been deleted or wherein any of these activities has been mutated so as to change the ultimate polyketide synthesized.

Thus, there are five degrees of freedom for constructing a polyketide synthase in terms of the polyketide that will be produced. First, the polyketide chain length will be determined by the number of modules in the PKS system. Second, the nature of the carbon skeleton of the PKS will be determined by the specificities of the acyl transferases which determine the nature of the extender units at each position—e.g. malonyl, methyl malonyl, or ethyl malonyl, etc. Third, the loading domain specificity will also have an effect on the resulting carbon skeleton of the polyketide. Thus, the loading domain may use a different starter unit, such as acetyl, propionyl, and the like. Fourth, the oxidation state at various positions of the polyketide will be determined by the dehydratase and reductase portions of the modules. This will determine the presence and location of ketone, alcohol, double bonds or single bonds in the polyketide.

Finally, the stereochemistry of the resulting polyketide is a function of three aspects of the synthase. The first aspect is related to the AT/KS specificity associated with substituted malonyls as extender units, which affects stereochemistry only when the reductive cycle is missing or when it contains only a ketoreductase since the dehydratase would abolish chirality. Second, the specificity of the ketoreductase will determine the chirality of any $\beta$-OH. Finally, the enoyl reductase specificity for substituted malonyls as extender units will influence the result when there is a complete KR/DH/ER available.

Thus, the modular nystatin PKS system permits a wide range of polyketides to be synthesized. As compared to the aromatic PKS systems, a wider range of starter units including aliphatic monomers (acetyl, propionyl, butyryl, isovaleryl, etc.), aromatics (aminohydroxybenzoyl), alicyclics (cyclohexanoyl), and heterocyclics (thiazolyl) are found in various macrocyclic polyketides. Recent studies have shown that modular PKSs have relaxed specificity for their starter units. Modular PKSs also exhibit considerable variety with regard to the choice of extender units in each condensation cycle. The degree of $\beta$-ketoreduction following a condensation reaction has also been shown to be altered by genetic manipulation (Donadio, S. et al. Proc. Natl. Acad. Sci. USA (1993) 90:7119-7123). Likewise, the size of the polyketide product can be varied by designing mutants with the appropriate number of modules (Kao, C. M. et al. J. Am. Chem. Soc. (1994) 116: 11612-11613). Lastly, these enzymes are particularly well-known for generating an impressive range of asymmetric centres in their products in a highly controlled manner. The polyketides and antibiotics produced by the methods of the present invention are typically single stereoisomeric forms. Although the compounds of the invention can occur as mixtures of stereoisomers, it is more practical to generate individual stereoisomers using this system. Thus, the combinatorial potential within modular PKS pathways based on any naturally occurring modular, such as the nystatin, PKS scaffold is virtually unlimited.

In general, the polyketide products of the PKS must be further modified, typically by glycosylation, in order to exhibit antibiotic activity. Methods for glycosylating the polyketides are generally known in the art; the glycosylation may be effected intracellularly by providing the appropriate glycosylation enzymes or may be effected in vitro using chemical synthetic means.

The macrolide antibiotics, polyketide moieties of which are synthesised by modular PKSs, may contain any of a number of different deoxysugars. The nystatin molecule contains mycosamine deoxysugar moiety. Deoxysugar biosynthesis starts typically with glucose-1-phosphate and proceeds through the action of dTDP-glucose synthase and dTDP-glucose-4,6-dehydratase. The product of the latter, typically a dTDP-4,6-keto-6-deoxyglucose, is further subjected to at least two of the following reactions—epimerisation, isomerisation, reduction, dehydration, transamination, or methylation—to give a dTDP-D-deoxysugar. The latter is then attached to the macrolactone ring via the action of a glycosyltransferase, hence providing for the glycosylation of the macrolide compound.

Glycosylation can also be effected using the non-glycosylated macrolides as starting materials, and using mutants of streptomycetes or other organisms (i.e. *Myxococcus, Pseudomonas, Mycobacterium* etc.) that can provide the glycosylation activities. Alternatively, glycosyltransferase-encoding genes from the organisms mentioned above can be introduced in *S. noursei* or other organisms containing the native or modified nystatin PKS genes or portions thereof in order to provide the desired glycosylation. The deoxysugar biosynthesis genes from the nystatin gene cluster can be used for complementation of corresponding activities in different PKS producers, as well as for engineering the biosynthetic pathways for alternative deoxysugars.

The derivatives of nystatin PKS can be prepared by manipulation of the relevant genes, or by introducing the nystatin genes or portions thereof into another PKS. A large number of modular PKS gene clusters have been mapped and/or sequenced, including erythromycin, soraphen A, rifamycin, avermectin and rapamycin, which have been completely mapped and sequenced, and FK506 and oleandomycin which have been partially sequenced, and candicidin, pimaricin and nemadectin which have been mapped and partially sequenced. Additional modular PKS gene clusters are expected to be available as time progresses. These genes can be manipulated using standard techniques to delete or inactivate activity encoding regions, insert regions of genes encoding corresponding activities from the same or different PKS systems, or otherwise mutate using standard procedures for obtaining genetic alterations. Of course, portions of, or all of, the desired derivative coding sequences can be synthesized using standard solid phase synthesis methods such as those described by Jaye et at., J. Biol. Chem. (1984) 259:6331, and which are available commercially from, for example, Applied Biosystems, Inc.

In order to obtain nucleotide sequences encoding a variety of derivatives of the naturally occurring PKS, and thus a variety of polyketides for construction of a library, a desired number of constructs can be obtained by "mixing and matching" enzymatic activity-encoding portions, and mutations can be introduced into the native host (i.e. nystatin) PKS gene cluster or portions thereof.

Mutations can be made to the native sequences using conventional techniques. The substrates for mutation can be an entire cluster of genes or only one or two of them; the substrate for mutation may also be portions of one or more of these genes. Techniques for mutation are well known in the art and described in the literature, for example in WO98/49315 and the references cited therein. Such techniques include preparing synthetic oligonucleotides including the mutation(s) and inserting the mutated sequence into the gene encoding a PKS subunit using restriction endonuclease digestion. (See, e.g. Kunkel, T. A., Proc. Natl. Acad. Sci. USA (1985) 82:448; Geisselsoder et al. BioTechniques (1987) 5:786.) Alternatively, the mutations can be effected using a mismatched primer (generally 10-20 nucleotides in length) which hybridizes to the native nucleotide sequence, at a temperature below the melting temperature of the mismatched duplex. The primer can be made specific by keeping primer length and base composition within relatively narrow limits and by keeping the mutant base centrally located (Zoller and Smith, Methods Enzymol. (1983) 100:468). Primer extension is effected using DNA polymerase, the product cloned and clones containing the mutated DNA, derived by segregation of the primer extended strand, selected. Selection can be accomplished using the mutant primer as a hybridization probe. The technique is also applicable for generating multiple point mutations. See, e.g. Dalbie-McFarland et al. Proc. Natl. Acad. Sci. USA (1982) 79:6409. PCR mutagenesis will also find use for effecting the desired mutations.

Random mutagenesis of selected portions of the nucleotide sequences encoding enzymatic activities can be accomplished by several different techniques known in the art, e.g. by inserting an oligonucleotide linker randomly into a plasmid, by irradiation with X-rays or ultraviolet light, by incorporating incorrect nucleotides during in vitro DNA synthesis, by error-prone PCR mutagenesis, by preparing synthetic mutants or by damaging plasmid DNA in vitro with chemicals. Chemical mutagens include, for example, sodium bisulfite, nitrous acid, nitrosoguanidine, hydroxylamine, agents which damage or remove bases thereby preventing normal base-pairing such as hydrazine or formic acid, analogues of nucleotide precursors such as 5-bromouracil, 2-aminopurine, or acridine intercalating agents such as proflavine, acriflavine, quinacrine, and the like. Generally, plasmid DNA or DNA fragments are treated with chemicals, transformed into E. coli and propagated as a pool or library of mutant plasmids.

In addition to providing mutated forms of regions encoding enzymatic or other functional activity, regions encoding the desired functions or activities may be recovered from different locations in the same nystatin PKS, for example, using PCR techniques with appropriate primers. By "corresponding" activity encoding regions is meant those regions encoding the same general type of activity—e.g. a ketoreductase activity in one location of a gene cluster would "correspond" to a ketoreductase-encoding activity in another location in the gene cluster.

If replacement of a particular target region in a host polyketide synthase is to be made (be this host nystatin PKS, or a different PKS into which "nystatin" sequences are to be inserted), this replacement can be conducted in vitro using suitable restriction enzymes or can be effected in vivo using recombinant techniques involving homologous sequences framing the replacement gene in a donor plasmid and a receptor region in a recipient plasmid, genome or chromosome. Such systems, advantageously involving plasmids of differing temperature sensitivities are described, for example, in PCT application WO 96/40968.

WO 00/77181 describes methods of assembling several DNA units in sequence into large DNA constructs which are applicable to the recombinant polyketide synthases within the scope of the invention.

The vectors used to perform the various operations to replace the enzymatic activity in the host PKS genes or to support mutations in these regions of the host PKS genes may be chosen to contain control sequences operably linked to the resulting coding sequences in a manner that expression of the coding sequences may be effected in a appropriate host. However, simple cloning vectors may be used as well.

If the cloning vectors employed to obtain PKS genes encoding derived PKS lack control sequences for expression operably linked to the encoding nucleotide sequences, the nucleotide sequences are inserted into appropriate expression vectors. This need not be done individually, but a pool of isolated encoding nucleotide sequences can be inserted into host vectors, the resulting vectors transformed or transfected into host cells and the resulting cells plated out into individual colonies.

Suitable control sequences include those which function in eucaryotic and prokaryotic host cells. Preferred hosts include prokaryotic hosts and fungal systems such as yeast, but single cell cultures of, for example, mammalian cells could also be used. There is no particular advantage, however, in using such systems. Particularly preferred are yeast and prokaryotic hosts which use control sequences compatible with *Streptomyces* spp. Suitable control sequences for single cell cultures of various types of organisms are well known in the art. Systems for expression in yeast, including control sequences which effect secretion are widely available and are routinely used. Control elements include promoters, optionally containing operator sequences, and other elements depending on the nature of the host, such as ribosome binding sites. Particularly useful promoters for prokaryotic hosts include those from PKS gene clusters which result in the production of polyketides as secondary metabolites, including those from aromatic (Type II) PKS gene clusters. Examples are act promoters, tcm promoters, spiramycin promoters, and the like. However, other bacterial promoters, such as those derived from sugar metabolizing enzymes, such as galactose, lactose (tac) and maltose, are also useful. Additional examples include promoters derived from genes encoding biosynthetic enzymes such as tryptophan synthase (trp), the β-lactamase (bla), bacteriophage lambda FL, T5 and T7. In addition, synthetic promoters, such as the tac promoter (U.S. Pat. No. 4,551,433), can be used.

Other regulatory sequences may also be desirable which allow for regulation of expression of the PKS replacement sequences relative to the growth of the host cell. Regulatory sequences are known to those of skill in the art, and examples include those which cause the expression of a gene to be turned on or off in response to a chemical or physical stimulus, including the presence of a regulatory compound. Other types of regulatory elements may also be present in the vector, for example, enhancer sequences.

Selectable markers can also be included in the recombinant expression vectors. A variety of markers are known which are useful in selecting for transformed cell lines and generally comprise a gene whose expression confers a selectable phenotype on transformed cells when the cells are grown in an appropriate selective medium. Such markers include, for example, genes which confer antibiotic resistance or sensitivity to the plasmid. Alternatively, several polyketides are naturally coloured and this characteristic provides a built-in marker for screening cells successfully transformed by the present constructs.

The various PKS nucleotide sequences, or a mixture of such sequences, can be cloned into one or more recombinant vectors as individual cassettes, with separate control elements, or under the control of, e.g. a single promoter. The PKS subunits or mixture of components can include flanking restriction sites to allow for the easy deletion and insertion of other PKS subunits or mixture components so that hybrid PKSs can be generated. The design of such unique restriction sites is known to those of skill in the art and can be accomplished using the techniques described above, such as site-directed mutagenesis and PCR.

As described above, particularly useful control sequences are those which themselves, or using suitable regulatory systems, activate expression during transition from growth to stationary phase in the vegetative mycelium. The system contained in plasmid RM5, i.e. the actI/actIII promoter pair and the actII-ORF4, an activator gene, is particularly preferred (McDaniel et al., Science, v. 262, p 1546-1550, 1993). Particularly preferred hosts are those which lack their own means for producing polyketides so that a cleaner result is obtained. Illustrative host cells of this type include the modified S. coeticotor CH$_{999}$ culture described in PCT application WO 96/40968 and similar strains of S. lividans.

The expression vectors containing nucleotide sequences encoding a modified PKS system or a variety of PKS systems for the production of different polyketides may then be transformed into the appropriate host cells, e.g. to construct a library. In one straightforward approach, a mixture of such vectors is transformed into the selected host cells and the resulting cells plated into individual colonies and selected for successful transformants. Each individual colony will then represent a colony with the ability to produce a particular PKS synthase and ultimately a particular polyketide. Typically, there will be duplications in some of the colonies; the subset of the transformed colonies that contains a different PKS in each member colony can be considered the library. Alternatively, the expression vectors can be used individually to transform hosts, which transformed hosts are then assembled into a library. A variety of strategies might be devised to obtain a multiplicity of colonies each containing a PKS gene cluster derived from the nystatin host gene cluster so that each colony in the library produces a different PKS and ultimately a different polyketide. The number of different polyketides that are produced by the library is typically at least three (e.g. 2 mutations in the PKS genes which may appear separately or in combination), more typically at least ten, and preferably at least 20, more preferably at least 50, reflecting similar numbers of different altered PKS gene clusters and PKS gene products. The number of members in the library is arbitrarily chosen; however, the degrees of freedom outlined above with respect to the variation of starter, extender units, stereochemistry, oxidation state, and chain length is quite large.

Methods for introducing the recombinant vectors of the present invention into suitable hosts are known to those of skill in the art and typically include the use of CaCl$_2$ or other agents, such as divalent cations, lipofection, conjugation, protoplast transformation and electroporation.

A wide variety of hosts can be used, even though some hosts natively do not contain the appropriate post-translational mechanisms to activate the acyl carrier proteins of the synthases. These hosts can be complemented with the appropriate recombinant enzymes, for example NysF, to effect these modifications.

The polyketide producing colonies can be identified and isolated using known techniques and the produced polyketides further characterized. The polyketides produced by these colonies can be used collectively in a panel to represent a library or may be assessed individually for activity.

The libraries can thus be considered at four levels: (1) a multiplicity of colonies each with a different PKS encoding sequence comprising a different PKS cluster but all derived from the nystatin PKS cluster; (2) colonies which contain the proteins that are members of the PKS produced by the coding sequences; (3) the polyketides produced; and (4) antibiotics derived from the polyketides.

Colonies in the library can be induced to produce the relevant synthases and thus to produce the relevant polyketides to obtain a library of candidate polyketides. The polyketides produced can be screened for antimicrobial, antitumour, antihelmintic or immunosuppressive activities, as well as for binding to desired targets, such as receptors, signalling proteins, and the like. The supernatants or culture pellets per se can be used for screening, or partial or complete purification of the polyketides can first be effected. Typically, such screening methods involve detecting the binding of each member of the library to receptor or other target ligand. Binding can be detected either directly or through a competition assay. Means to screen such libraries for binding are well known in the art.

Alternatively, individual polyketide members of the library can be tested against a desired target. In this event, screens wherein the biological response of the target is measured can more readily be included.

A large number of novel polyketides may be prepared according to the method of the invention, as illustrated by the representative in the Examples below. These novel polyketides may be useful intermediates in formation of compounds with antibiotic activity through glycosylation or reactions as described above. As indicated above, the individual polyketides may be reacted with suitable sugar derivatives to obtain compounds of antibiotic activity. Antibiotic activity can be verified using typical screening assays such as those set forth in Lehrer, R. et al., J. Immunol. Meth. (1991) 137: 167-173.

Thus, in a further aspect, the invention provides a method of preparing a nucleic acid molecule comprising a nucleotide sequence encoding a modified nystatin PKS, wherein said modified nystatin PKS is derived from a nystatin PKS as defined herein (i.e. a naturally occurring nystatin PKS) encoded by a nucleotide sequence as defined herein) containing first regions which encode enzymatic or other functional activities and second regions which encode scaffolding amino acid sequences, said method comprising (a) modifying at least one said first region; or (b) incorporating at least one said first region into a scaffolding-encoding second region from a different PKS-encoding nucleotide sequence.

As discussed above in relation to the nucleic acid molecules of the invention, the first region may be any part (e.g. encoding a domain or a module or a part thereof) of a nucleotide sequence of the invention (i.e. SEQ ID NO 1 or 2 or 35).

Also provided are (i) a method of preparing a modified nystatin PKS as defined above, said method comprising expressing a nucleic acid molecule prepared as defined above within a host cell (i.e. culturing or growing a host cell containing such a nucleic acid molecule) under conditions whereby the modified nystatin PKS is expressed), and (ii) a modified nystatin PKS so produced or so obtainable.

New polyketides produced by such a modified PKS are also within the scope of the invention, as are new antibiotics which are generally the glycosylated forms of these polyketides although some have activity without glycosylation which may be due to different post-translation modifications such as hydroxylation or oxidation.

The invention will now be described in more detail in the following non-limiting Examples with reference to the drawings in which:

FIG. 1 shows the structure of the polyene antifungal antibiotic nystatin A1;

FIG. 2 presents physical and functional maps of the *E. coli*—*Streptomyces* shuttle vector pSOK101, pSOK201 and pSOK804 used in Examples 1, 2 and 3;

Figure 7:
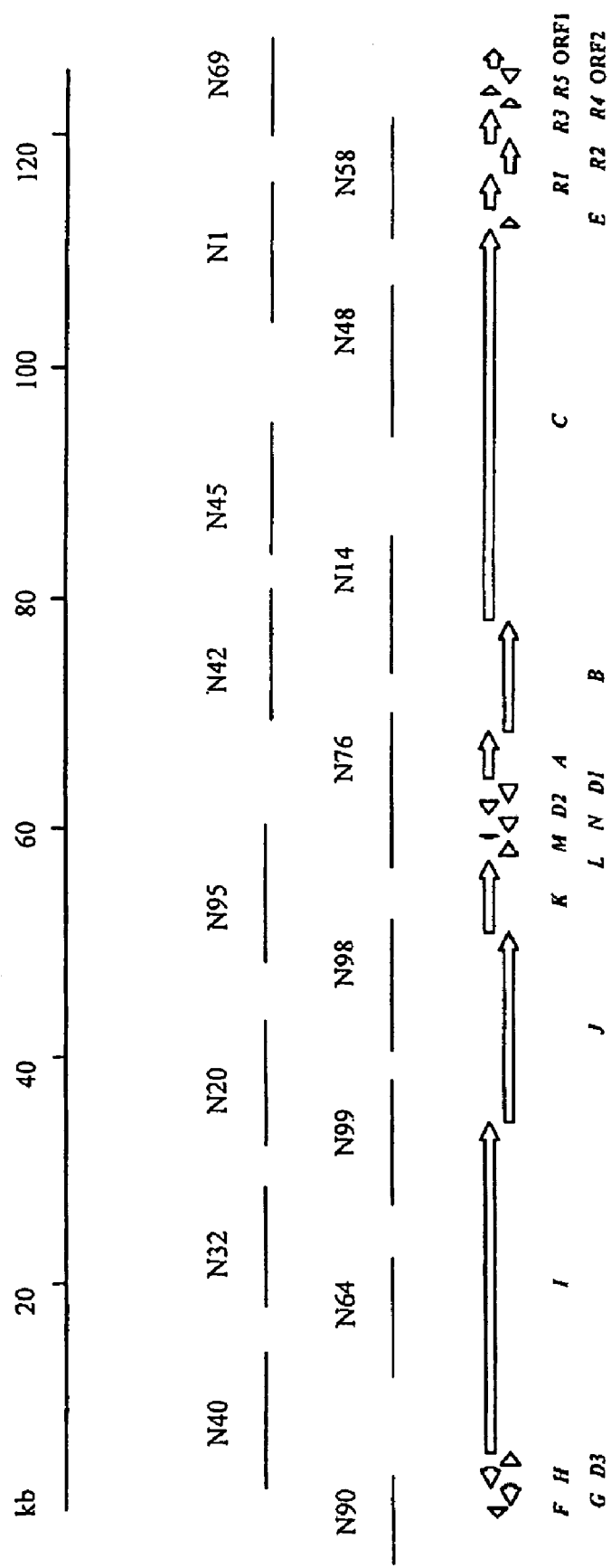
Figure 8:
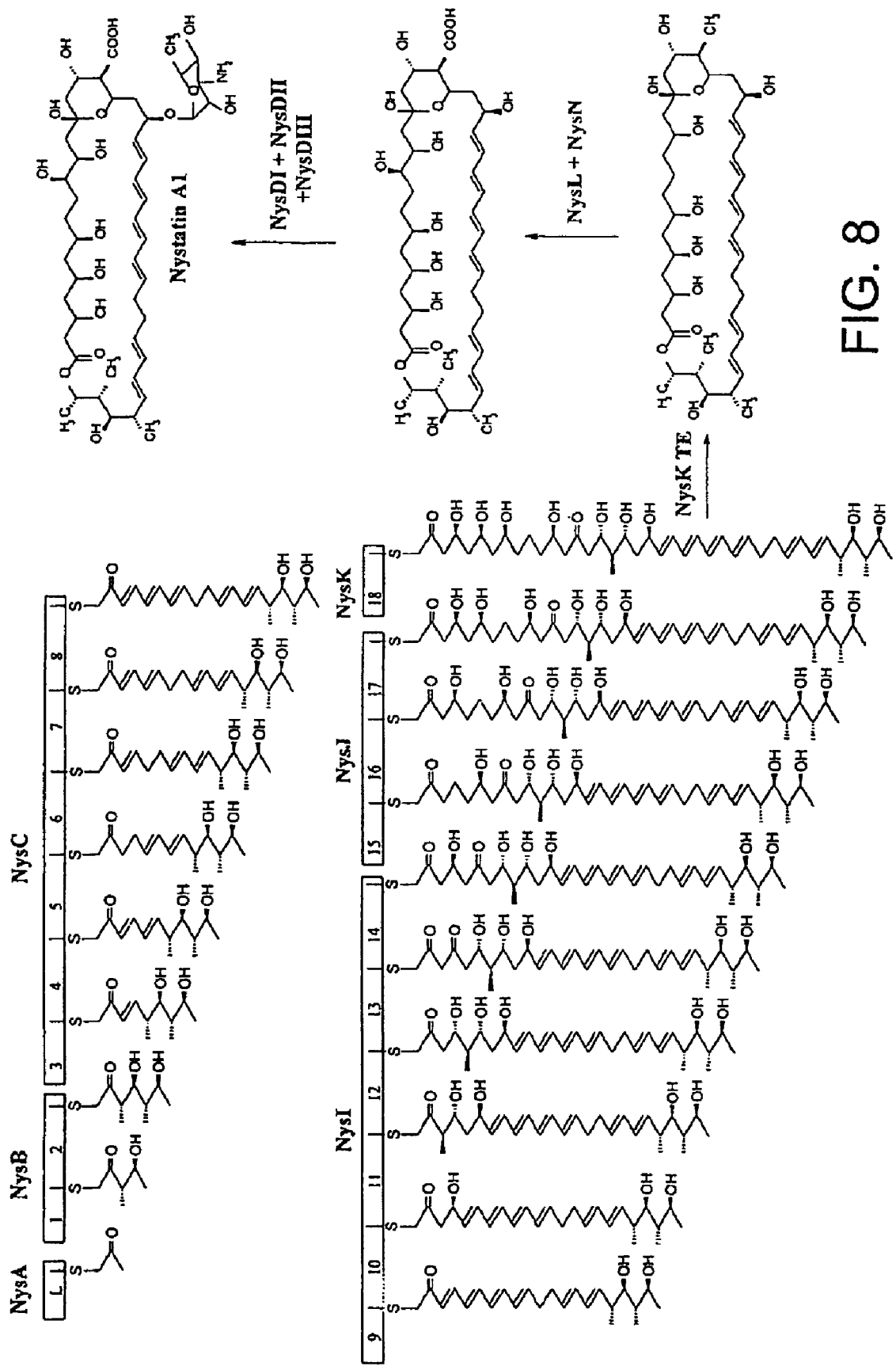
Figure 9:
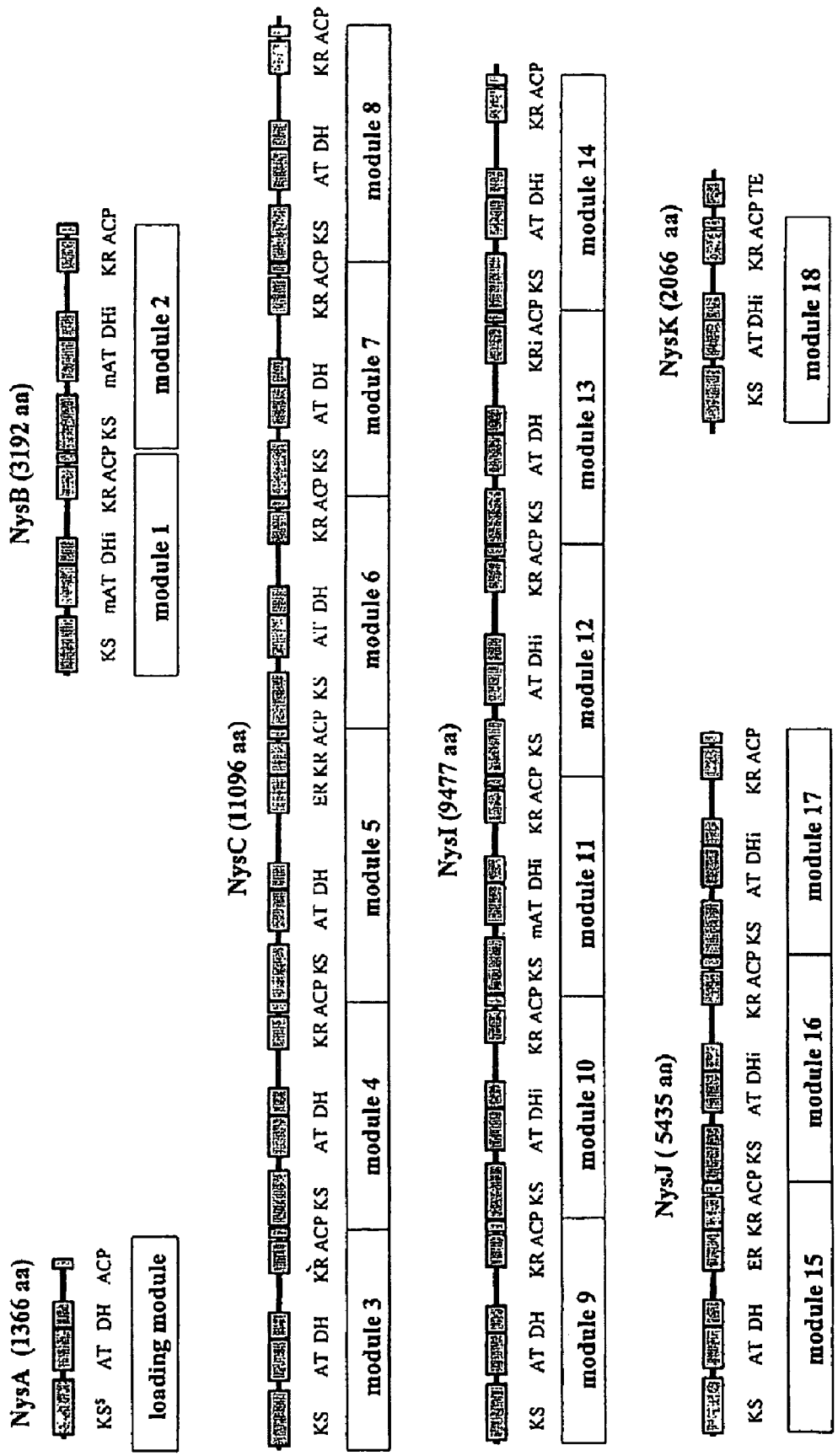

FIG. 7 is a schematic representation showing the region of the *S. noursei* ATC11455 genome encoding the nystatin biosynthetic gene cluster (corresponding to SEQ ID No. 35). Gene organisation within the gene cluster is shown. The inserts from the overlapping recombinant phages encompassing the cloned region are shown above the physical/genetic map. The nys genes are designated with capital letters in italic, other ORFs are numbered;

FIG. 8 is a representation showing a proposed model for nystatin biosynthesis in *S. noursei*; and FIG. 9 is a schematic representation showing the functional organisation of the nystatin PKS NysA (SEQ ID No. 5), NysB (SEQ ID No. 6), NysC (SEQ ID No. 7), NysI (SEQ ID No. 37), NysJ (SEQ ID No. 38) and NysK (SEQ ID No. 39) proteins. KS$^s$—ketosynthase with the Cys to Ser substitution in active site; KS—ketosynthase; AT—acetate-specific acyltransferase; mAT—propionate-specific acetyltransferase; DH—dehydratase; DHi—inactive dehydratase; ER—enoyl reductase; KR—detoreductase; KRi—inactive ketoreductase; ACP—acyl carrier protein.

Figure 10:
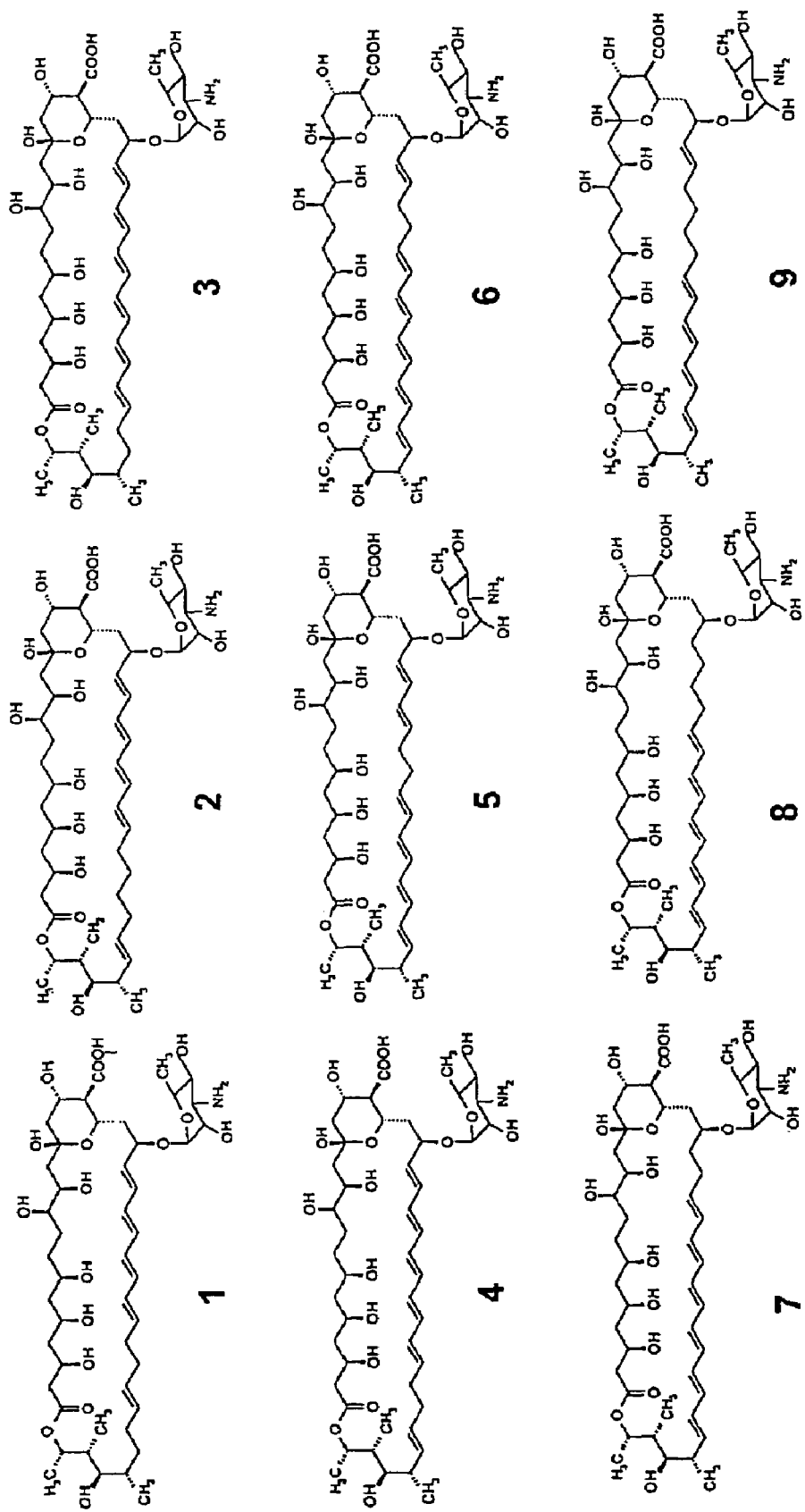

FIG. 10 shows compounds that can be theoretically produced from the following manipulations within the nystatin gene cluster insertion of ER domain into module 3 (1)

insertion of ER domain into module 4 (2);

simultaneous inactivation of the ER domain in module 5 and insertion of the ER domain into module 3 (3);

simultaneous inactivation of the ER domain in module 5 and insertion of the ER domain into module 4 (4);

simultaneous inactivation of the ER domain in module 5 and insertion of the ER domain into module 7 (5);

simultaneous inactivation of the ER domain in module 5 and insertion of the ER domain into module 8 (6);

simultaneous inactivation of the ER domain in module 5 and insertion of the ER domain into module 9 (7);

simultaneous inactivation of the ER domain in module 5 and insertion of the ER domains into modules 8 and 9 (8);

simultaneous inactivation of the ER domain in module 5 and insertion of the ER domains into modules 7 and 8 (9).

Figure 11:
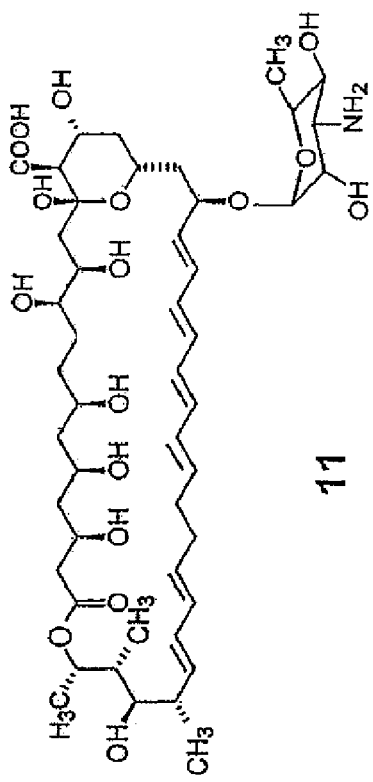
Figure 11:
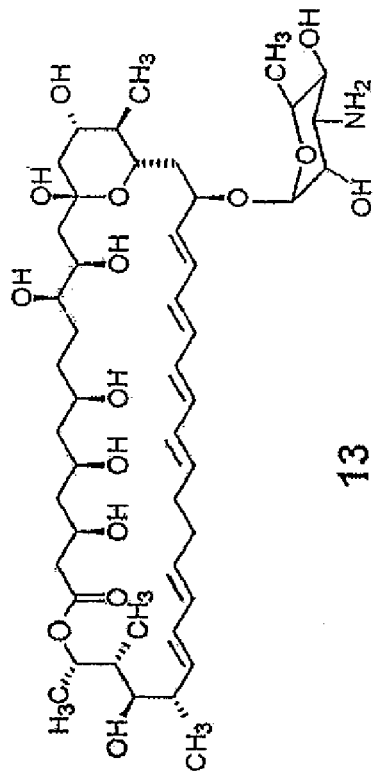
Figure 11:
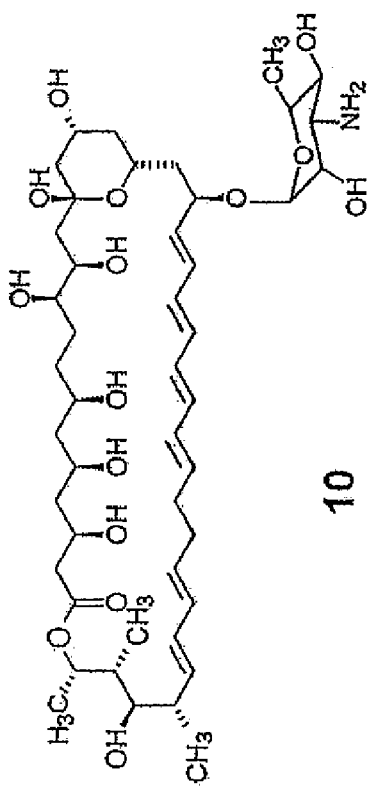
Figure 11:
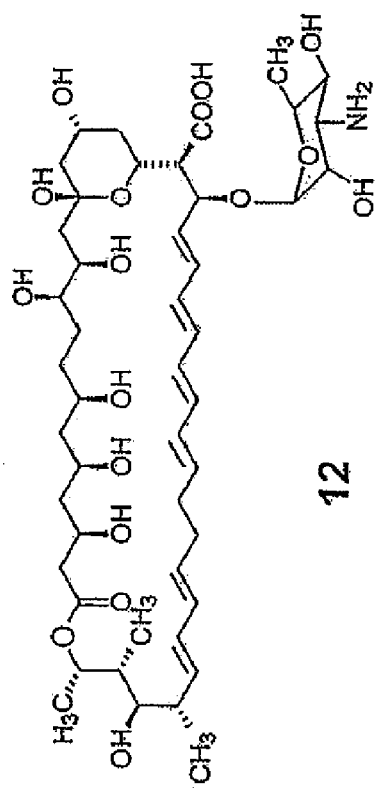

FIG. 11 shows compounds that can be theoretically produced from the following manipulations within the nystatin gene cluster:

replacement of methylmalonyl-specific acetyltransferase (AT) domain in module 11 of the nystatin PKS with malonyl-specific AT domain (10);

replacement of malonyl-specific AT domain in module 12 with methylmalonyl-specific AT domain with simultaneous replacement of methylmalonyl-specific AT domain in module 11 with malonyl-specific AT domain (11);

replacement of malonyl-specific AT domain in module 10 with methylmalonyl-specific AT domain with simultaneous replacement of methylmalonyl-specific AT domain in module 11 with malonyl-specific AT domain (12);

inactivation of P450 monooxygenase-encoding genes nysL or nysN (whichever is found to be responsible for oxygenation of the methyl group at C-16 on the nystatin molecule) (13).

Figure 12:
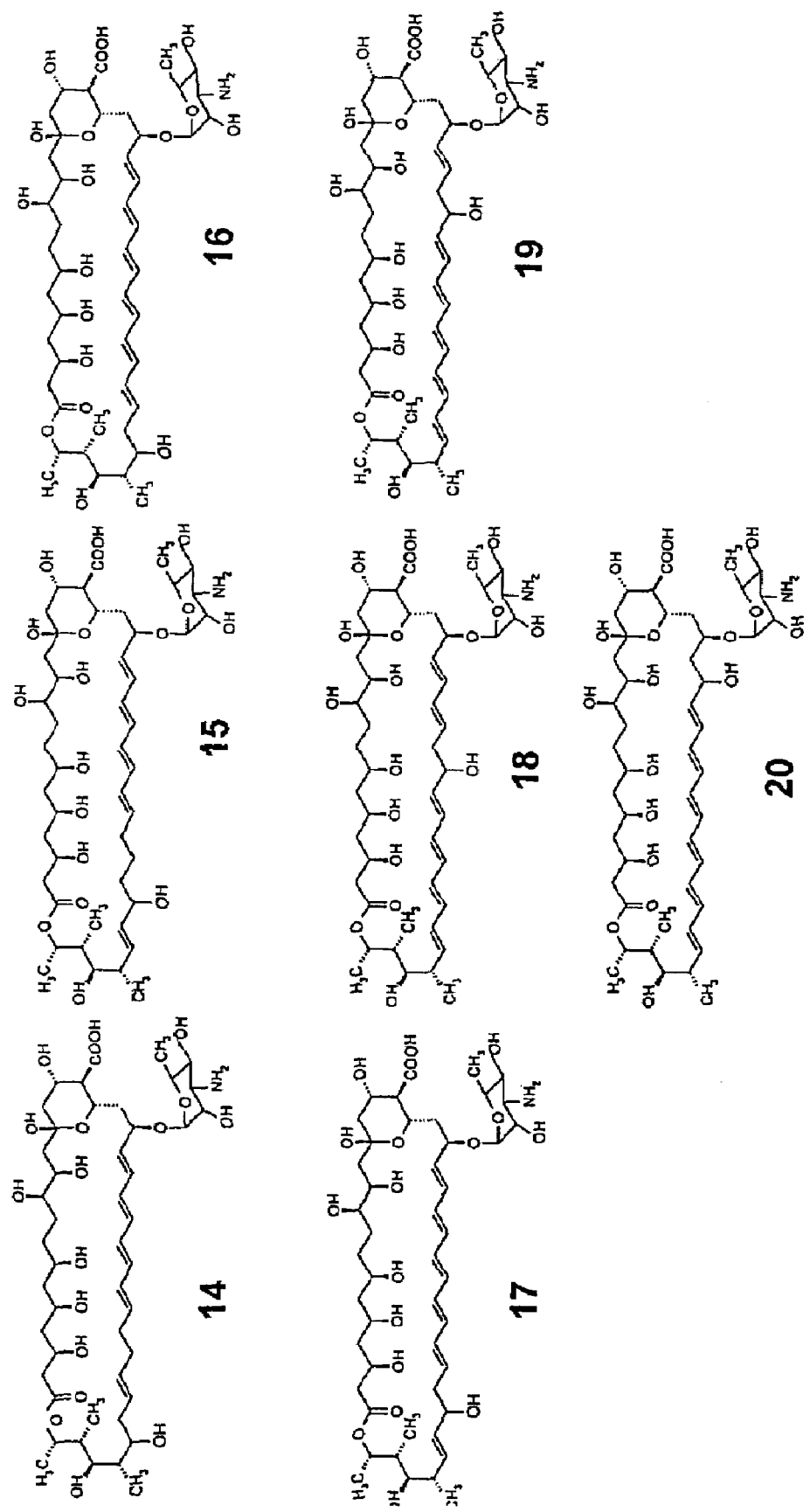

FIG. 12 shows compounds that can be theoretically produced from the following manipulations within the nystatin gene cluster:

inactivation of dehydratase DH domain in module 3 of the nystatin PKS (14);

inactivation of DH domain in module 4 (15);

inactivation of DH domain in module 3 with simultaneous inactivation of ER domain in module 5 (16);

inactivation of DH domain in module 4 with simultaneous inactivation of ER domain in module 5 (17);

inactivation of DH domain in module 7 with simultaneous inactivation of ER domain in module 5 (18);

inactivation of DH domain in module 8 with simultaneous inactivation of ER domain in module 5 (19);

inactivation of DH domain in module 9 with simultaneous inactivation of ER domain in module 5 (20).

EXAMPLE 1

Cloning of the Nystatin Biosynthesis Gene Cluster

Bacterial Strains, Plasmids and Growth Conditions

Figure 3:
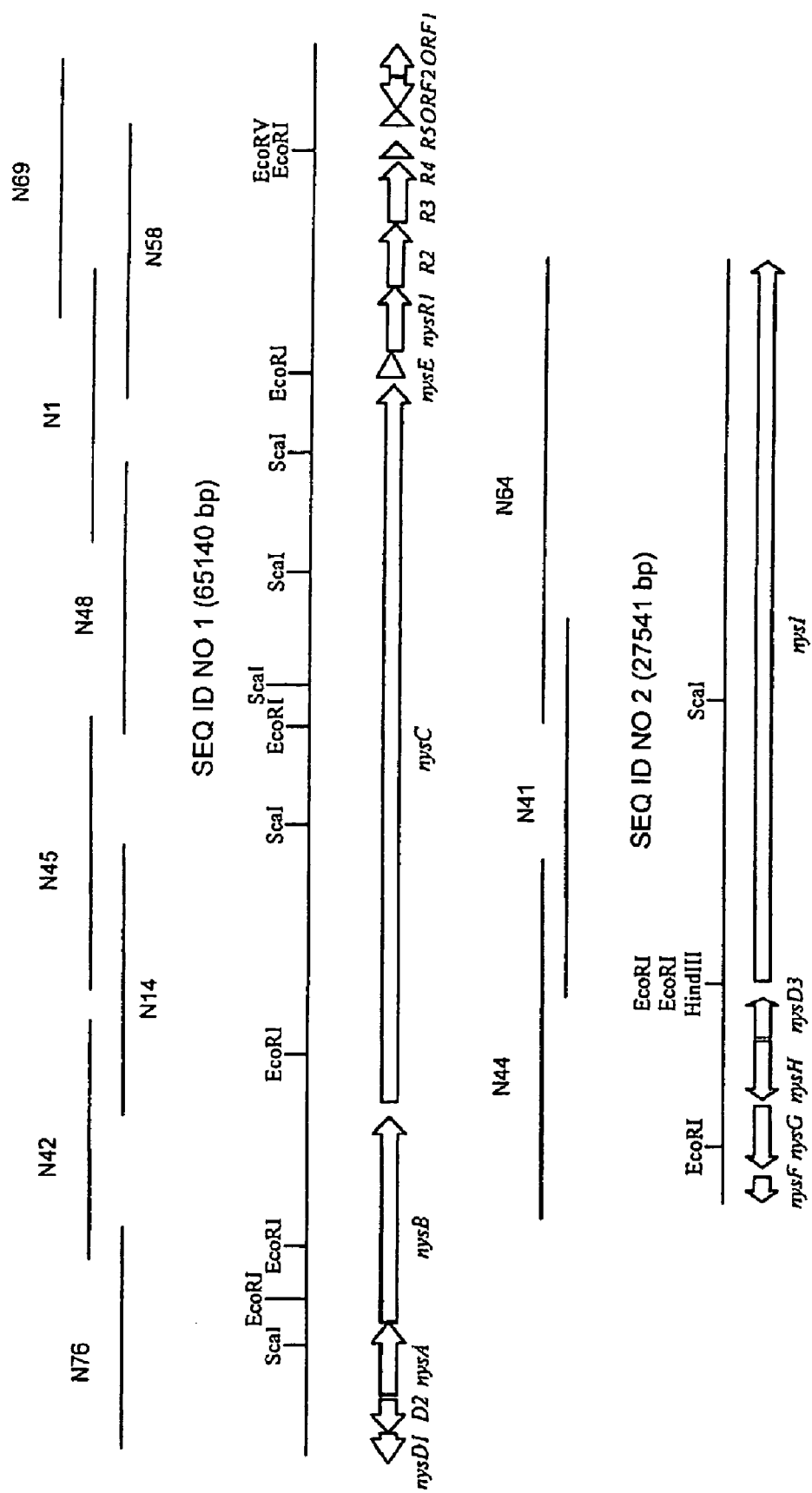
FIG. 3 is a schematic representation showing two regions of the *S. noursei* ATCC11455 genome encoding the nystatin biosynthesis gene (corresponding to SEQ ID NOs 1 and 2). Overlapping recombinant phages containing the presented DNA sequences are shown over the regions drawings (see Example 1)

Bacterial strains and plasmids used in this study are listed in Table 3. New strains and plasmids developed in the course of this study are described herein and shown in FIG. 3. *S. noursei* ATCC 11455 and its mutants were grown on solid ISP2 medium (Difco), and in liquid TSB medium (Oxoid).

Intergeneric conjugation from *E. coli* ET12567 (pUZ8002) into *Streptomyces* strains was done as described in Flett et al, FEMS Microbial Lett., v. 155: 223-229, (1997), except for the "heat shock" time, which was reduced to 5 minutes. Apramycin (Fluka) at a concentration 50 mg/ml was used to select for the *S. noursei* transconjugants on solid medium. For inoculation of the *S. noursei* ATCC11455 transconjugants prior to total DNA isolation, liquid medium TSB supplemented with 20 μg/ml apramycin was used. *E. coli* strains were grown and transformed as described in Sambrook et al, Cold Spring Harbor Laboratory (1989). *E. coli* ET12567 (pUZ8002) was maintained on the media containing 20 μg/ml chloramphenicol and 50 μg/ml kanamycin.

TABLE 3

Bacterial strains, plasmids and phages used in this study

| Strain, plasmid or phage | Properties | Source or reference |
|---|---|---|
| *E. coli* DH5α | general cloning host | Sambrook et al, 1989, supra |
| *E. coli* XL1-Blue MRA (P2) | host for the gene library | Stratagene |
| *E. coli* ET12567 | strain for intergeneric conjugation | MacNeil et al, Gene, v. 111: 61-68, 1992 |
| *S. noursei* ATCC 11455 | wild type, nystatin producer | ATCC |
| pGEM3Zf(—) | ColE1 replicon, $Ap^R$, 3.2 kb | Promega |
| pGEM72f(—) | ColE1 replicon, $Ap^R$, 3.0 kb | Promega |
| pGEM11Zf(—) | ColE1 replicon, $Ap^R$, 3.2 kb | Promega |
| pUZ8002 | RK2 derivative, $Km^R$, $Tc^R$ | D. H. Figurski |
| pWHM3 | ColE1 + pIJ101 replicons, $Thio^R$, 7.2 kb | Vara et al, J. Bacteriol v. 171: 5872-5881, 1989 |
| pSET152 | ColE1 replicon + øC31 int, oriT, $Am^R$, 5.5 kb | Bierman et al, Gene, v. 116: 43-49, 1992 |
| pSOK101 | pWHM3 derivative in which the 3.1 kb BamHI/SphI fragment was replaced with the 3.0 kb BamMI/SphI fragment from pSET152 containing ColEI, oriT and $Am^R$, 7.1 kb | This work (see FIG. 2) |
| pGM11 | pSG5 replicon, $Neo^R$, 5.3 kb | Wohlleben & Muth, In "Plasmids, a practical approach", Ed. Hardy, IRL Press, p 147-175, 1993 |
| pSOK201 | pGM11 derivative in which the 1.2 kb EcoRI/HindIII fragment was replaced with the 3.0 kb EcoRI/HindIII fragment from pSOK101 containing ColEI, oriT and $Am^R$, 7.1 kb | This work (see FIG. 2) |
| DASHII | bacteriophage λ vector | Stratagene |
| pSOK804 | ColEI replicon, $Am^R$, OriT, $int_{WVB}$, $AttP_{WVB}$ | This work (see FIG. 2) and Van Mellaert et al., Microbiol., v. 144: 3351-3358, 1998 |
| pGEM7ermELi | pGEM7ZF plasmid containing PermE* promoter | C. R. Hutchinson |

Am—apramycin,
Ap—ampicilli,
Neo—neomycin,
Thio—thiostrepton,
Km—kanamycin,
Tc—tetracycline Analysis of the Secondary Metabolite Production Fermentations were performed in Applicon 3-1 fermenters containing initially 1.31 SAO-23 medium containing ($gl^{-1}$): glucose.$H_2O$, 90; $NH_4NO_3$, 2.5; corn flour, 3.0; $MgSO_4.7H_2O$, 0.4; $KH_2PO_4$, 02; $CaCO_3$, 7; trace element solution, 3 ml. Trace element solution ($gl^{-1}$):$FeSO_4.7H_2O$, 5.0; $CuSO_4.5H_2O$, 0.39; $ZnSO_47H_2O$, 0.44; $MnSO_4H_2O$, 0.15; $Na_2MoO_4.2H_2O$, 0.01; $CoCl_2.6H_2O$, 0.02; HCl, 50. The fermentations were performed at 28° C. with pH controlled at 6.5-7.0 by HCl (2M) and NaOH (2M). The dissolved oxygen was controlled at >40% of saturation by the agitation (300-900 rpm) and aeration (0.25 vvm). Inocula for the fermentations (3 vol-%) with SAO-23 medium were grown in TSB-medium (TSB, Oxoid CM129, 37 $gl^{-1}$) at 28° C. in shake flasks (500-ml baffled Erlenmeyer flasks with 100 ml medium; 200 rpm). Each shake flask was inoculated with 0.2 ml spore suspension and incubated for 18-20 hours. Nystatin production was assayed by HPLC of the dimethylformamide extracts of the cultures after fermentations (Raatikainen, J. Chromatogr., v. 588, 356-360, (1991)).

DNA Manipulation

Plasmid, phage and total DNA preparations, endonuclease digestions, ligations and fractionation were performed as described previously (Sambrook et al., 1989, supra; Hopwood et al, 1985, supra). DNA fragments were isolated from agarose gels using the QIAGEN Kit (QIAGEN GmbH), labelled with the use of the digoxygenin kit from Boehringer Mannheim and used for Southern blot analysis according to the manufacturer's manual. DNA sequencing was performed at QIAGEN GmbH (Germany), and the data were analysed with the GCG software (Devereux et al, Nucleic Acids Res. v. 12: 387-395, 1984).

PCR-Assisted Amplification and Cloning of a PKS-Encoding DNA Fragment from the *S. noursei* ATCC11455 Genome In order to obtain the DNA encoding the nystatin biosynthesis genes, the *S. noursei* ATCC1455 gene library was probed with labelled PKS-encoding DNA. To obtain the DNA probe, degenerate oligonucleotide primers were designed, which correspond to conserved amino acid regions within β-ketoacyl synthase (KS) and acyl carrier protein (ACP) domains of known modular PKSs. The degenerate primers used for amplification corresponded to the conserved amino acid motifs in ACP and KS domains in known PKS, and were designed according to the codon usage table for *Streptomyces* (Wright & Bibb, Gene, v. 113: 55-65, 1992). The ACP nucleotide primer (sense) corresponded to the motif Glu(Asp)Leu Gly Phe(Leu, Val) Asp Ser Leu (SEQ ID NO:21) and had the sequence 5'-GAG/C CTG/C GGC/G T/CTG/C GAC TCC/G CTG/C-3 (SEQ ID NO: 22). The KS nucleotide primer (antisense) corresponded to the motif Val Asp Thr Ala Cys Ser Ser (SEQ ID NO: 23) and had the sequence 5'-G/CGA G/CGA G/ACA/G/CGC C/GGT GTC G/CAC-3' (SEQ ID NO: 24). Total DNA isolated from the *S. noursei* ATCC11455 was used as a template for polymerase chain reaction (PCR)-assisted amplification of the DNA fragment from the genome of this organism with the use of KS and ACP oligonucleotide primers. From the relative position of the motifs on the modular PKSs it was assumed that resulting PCR product would be approx 0.7 kb in size. The 50 µl PCR mixture contained 0.1 µg of *S. noursei* ATCC11455 total DNA, 25 pm of each ACP and KS oligonucleotide primers dNTPs (final concentration 350 µm), 1×PCR buffer from Expand High Fidelity PCR System (Boehringer Mannheim), and 1.5 U of the DNA polymerase mixture from the same system. The PCR was performed on the Perkin Elmer GeneAmp PCR System 2400 with the following program: 1 cycle of denaturation at 96° C. (4 min), 35 cycles of denaturation/annealing/synthesis at 94° C. (45 sec) and 70° C. (5 min) and 1 cycle of final annealing/extension at 72° C. (7 min). The 0.7 kb DNA fragment obtained with this procedure was cloned in pUC18 vector in *E. coli* DH5α with the use of Sure Clone Ligation Kit (Pharmacia). One of the resulting recombinant plasmids, pPKS72 of 3.5 kb, was subjected to DNA sequence analysis.

Subsequent cloning in *Escherichia coli* vector pUC18 and DNA sequencing of the resulting 0.7 kb PCR product, followed by conceptual translation and database search, confirmed that it encodes part of PKS type I. This DNA fragment was used as a probe for screening a *S. noursei* ATCC11455 gene library constructed in the phage vector DASHIII (see below) and one recombinant phage, designated lambda DASHII-N1, which hybridized to the probe, was isolated. As described further below, DASHII-N1 was used to generate further probes.

Construction and Screening of the *S. noursei* ATCC1455 Gene Library

The *S. noursei* ATCC11455 gene library was constructed in phage lambda vector DASHII (Stratagene) according to manufacturer's instructions. Total DNA from *S. noursei* ATCC11455 was isolated as described in Hopwood et al (1985) supra, partially digested with Sau3 AI restriction enzyme and fractionated on the sucrose gradient as described in Sambrook et al (1989), supra. The fractions of *S. noursei* ATCC1455 DNA containing fragments of 13-17 kb in size were used for ligation with the DASHII vector arms digested with BamHI restriction enzyme. *E. coli* XL1-Blue MRA (P2) (Stratagene) was used as a host for a gene library construction and propagation.

DNA fragments to be used as probes for screening the gene library were purified from agarose gels using QIAGEN Kit (QIAGEN GmbH, Germany), and labelled by the use of the digoxygenin (DIG) kit from Boehringer Mannheim (Germany), according to the manufacturer's instructions. Probes used for the library screening and relevant recombinant phages discovered:

| Probe | DASHII recombinant phages found using this probe |
|---|---|
| PKS72 | N1, N14 |
| E12.1: from N1 | N41, N42, N44, N45, N48 |
| E4.7.2: from N1 | N58 |
| L42E9.1: from N42 | N64, N76 |
| B1.0_58: from N58 | N69 |

Description of the Probes:

1. PKS72 probe. The 0.7 kb DNA fragment isolated from the pPKS72 plasmid (see above) with restriction enzymes EcoRI and HindIII was used as a PKS72 probe.

2. E12.1 probe. The 2.6 kb BamHI fragment from the insert of recombinant phage N1, representing its left flanking region, was subcloned into pGEM3Zf(-), resulting in plasmid pGEM (B2.6)-1. This plasmid was digested with EcoRI/AvaI, and the 0.55 kb fragment corresponding to the left end of the N1 DNA insert was purified and used as E12.1 probe.

3. E4.7.2 probe. The 4.7 kb EcoRI fragment from the recombinant phage N1, representing its right flanking region was subcloned into pGEM3Zf(-), resulting in plasmid pGEM (E4.7)-1. This plasmid was digested with EcoRI/HindIII, and the 1.5 kb DNA fragment corresponding to the right end of the N1 DNA insert was purified and named E4.7.2.

4. L42E9.1 probe. The 9.0 kb EcoRI fragment representing the left flanking region of the DNA insert in the recombinant phage N42 was subcloned into pGEM3Zf(-), resulting in plasmid pH42E9.1. This plasmid was digested with EcoRI/BamHI, and the 0.6 kb fragment corresponding to the left flank of the N42 DNA insert was purified and used as L42E9.1 probe.

5. L58B1.0 probe. The 3.0 kb EcoRI fragment representing the right flanking region of the recombinant phage N58 DNA insert was subcloned into pGEM3Zf(-), resulting in plasmid pGEM(E3.0)-58. From the latter plasmid, the 1.0 kb BamHI fragment which is located on the right end of the N58 DNA insert was purified and used as L58B1.0 probe.

Gene Disruption Experiment with the Nystatin Biosynthesis Gene Cluster

A 4.2 kb BamHI DNA fragment isolated from the DASHII-N1 recombinant phage was first cloned into the pGEM3Zf(-) vector in *E. coli*, resulting in the plasmid pGEM 4.2-1. DNA sequences on both ends of the cloned fragment were determined and, after database search, were found to encode PKS type I. The *S. noursei* DNA fragment cloned in pGEM4.2-1 was excised from this plasmid with restriction enzymes EcoRI and HindIII, and ligated with the 3.0 kb EcoRI/HindIII fragment from the vector pSOK201 (see Table 3 and FIG. 3), and transformed into *E. coli*. Plasmid DNA designated pKO (4.2)-1 was recovered from transformants, and then was transferred into *S. noursei* ATCC1455 by conjugation as described in Example 1 under "Bacterial strains, plasmids and growth conditions".

Since pKO(4.2)-1 is not capable of replicating in *S. noursei* ATCC11455, it was assumed that it will function as a suicide vector integrating into the genome of *S. noursei* via homologous recombination. As a result of such recombination, a PKS gene in the *S. noursei* ATCC11455 genome, for which 4.2 kb BamHI fragment cloned in pKO(4.2)-1 was presumed to be internal, would have been inactivated by disruption of its coding region. Integration of pKO(4.2)-1 into the genome of the three S. noursei transconjugants was confirmed by Southern blot analysis with the use of labelled 4.2 kb BamHI fragment from pGEM4.2-1 as a probe. One of the S. noursei disruption mutants carrying pKO(4.2)-1 integrated into its genome was tested for nystatin production in parallel with the parental strain ATCC11455 (see above for methods under "analysis of secondary metabolite production". While the latter was shown to produce nystatin at the expected level; no nystatin production was detected in the pKO(4.2)-1 disruption mutant, thus confirming the requirement of the identified PKS for nystatin biosynthesis.

Cloning of the Nystatin Biosynthesis Gene Cluster

Figure 4:
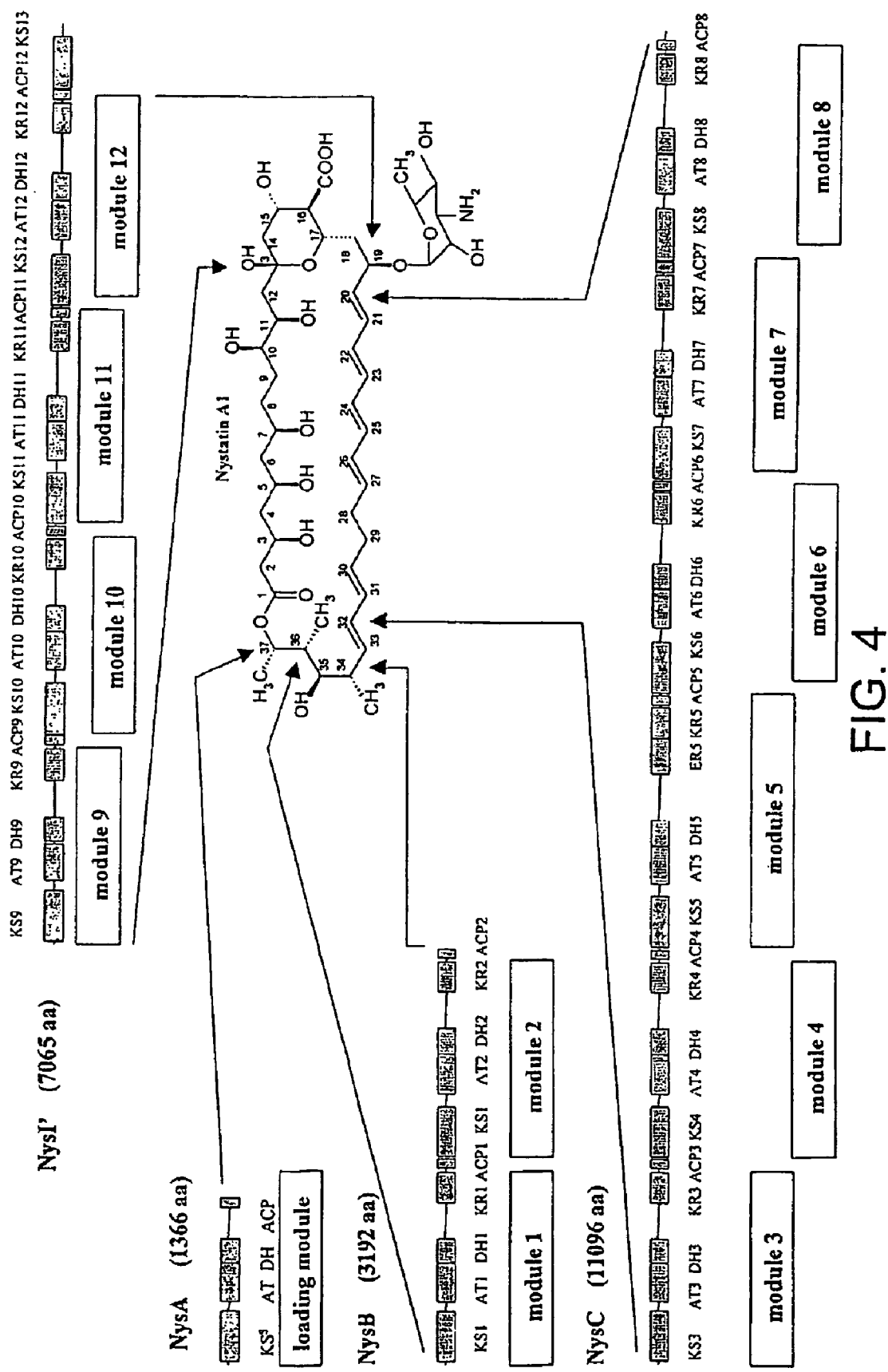
FIG. 4 is a schematic representation showing the functional organisation of the nystatin PKS NysA (SEQ ID NO 5), NysB (SEQ ID NO 6), NysC (SEQ ID NO 7) and NysI (SEQ ID NO 20) and their roles in nystatin biosynthesis.

In order to clone the entire gene cluster for the nystatin biosynthesis, the DNA fragments derived from the ends of the S. noursei DNA insert in the recombinant phage DASHII-N1 (N1), and subsequently found overlapping recombinant phages, were used as probes for screening the gene library (see above for probes). This screen resulted in isolation of the recombinant phages N14, N41, N42, N44, N45, N48, N58, N64, N69, and N76 comprising two regions (SEQ ID NOs 1 and 2 respectively) of the S. noursei ATCC11455 genome (approx. 98 kb total), as depicted in FIG. 4. A gene disruption experiment with the 4.3 kb EcoRI/BamHI DNA fragment derived from the recombinant phage N64 (performed essentially the same way as described above), confirmed that the second region (SEQ ID NO. 2) also encodes nystatin biosynthesis genes.

DNA Sequence Analysis of the Nystatin Biosynthesis Gene Cluster

The complete DNA inserts from recombinant phages mentioned above were subcloned either as XbaI or EcoRI fragments into pGEM3Zf(−) vector in an E. coli host, and nucleotide sequences were determined on both DNA strands of these fragments. Computer-assisted analysis of the DNA sequences comprising the two regions of the nystatin biosynthesis gene cluster (SEQ ID NOs 1 and 2 respectively) resulted in identification of the genes shown on FIG. 4 and listed in Table 4.

TABLE 4

Genes identified within the nystatin biosynthesis gene cluster of S. noursei

| Designation | Product | Putative function |
|---|---|---|
| nysR1 | transcriptional activator | regulation of nystatin production |
| nysR2 | transcriptional activator | regulation of nystatin production |
| nysR3 | transcriptional activator | regulation of nystatin production |
| nysR4 | transcriptional activator | regulation |
| nysR5 | transcriptional repressor | regulation |
| ORF1 | peptidase | peptide metabolism |
| ORF2 | transcriptional activator | regulation |
| nysA | PKS type I | nystatin polyketide backbone synthesis (loading module) |
| nysB | PKS type I | nystatin polyketide backbone synthesis (modules 1&2) |
| nysC | PKS type I | nystatin polyketide backbone synthesis (modules 3-8) |
| nysI (incomplete) | PKS type I | nystatin polyketide backbone synthesis (modules 9-13) |
| nysE | thioesterase | release of final product from PKS |
| nysD1 | glycosyltransferase | attachment of mycosamine to the polyketide backbone |
| nysD2 | aminotransferase | mycosamine biosynthesis |
| nysD3 | GDP-mannose-4,6-dehydratase | mycosamine biosynthesis |
| nysH | ABC transporter | efflux of nystatin |
| nysG | ABC transporter | efflux of nystatin |
| nysF | 4'-phosphopantetheine transferase | post-translational modification of PKS |

Figure 1:
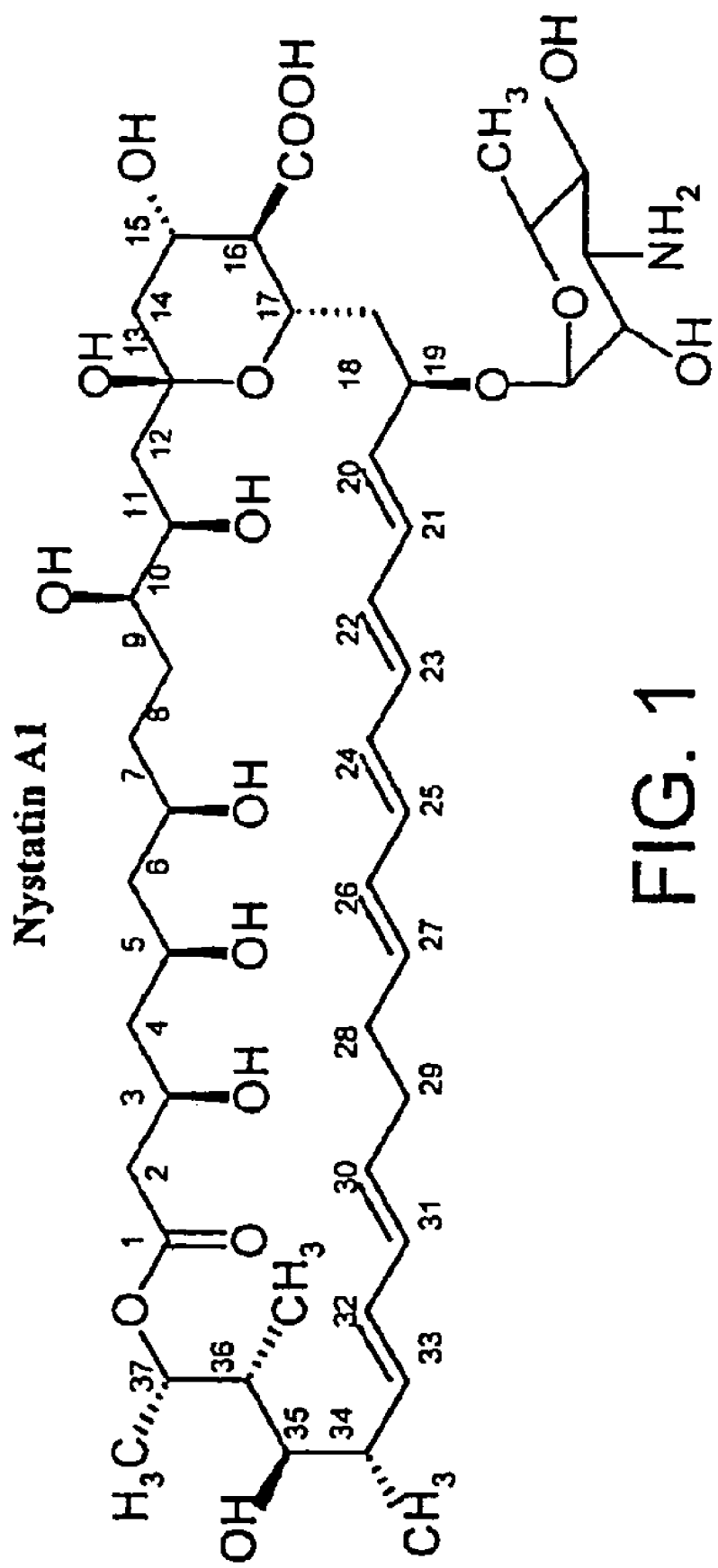

Three complete (nysA, nysB and nysC) (in SEQ ID NO:1), and one incomplete (nysI) genes (in SEQ ID NO:2) encoding the PKSs type I were identified. The amino acid (aa) sequences of the products encoded by these four genes were analysed by comparison to the aa sequences of known PKSs type I (see also Table 2 above for molecule features). Since all four proteins displayed high degree of homology towards rifamycin and rapamycin PKSs (Aparicio et al., Gene, v. 169: 9-16, 1996; Tang et al., Gene, v. 216: 255-265, 1998), pre-sumptive functional analysis of nystatin PKSs was based on comparison to the formers. The NysA protein of 1366 aa encodes one module of PKS composed of $KS^s$, AT, DH, KR, and ACP domains. The lack of a conserved cysteine residue in $KS^s$ domain suggests that this module cannot perform condensation reaction, and thus most probably represents a loading module providing the acetate starter unit for initiation of nystatin polyketide backbone biosynthesis (Bisang et al., Nature, v. 401: 502-505, 1999). Analysis of the 3192 aa sequence of NysB revealed that it contains two modules with KS, AT, KR, ACP, and apparently inactive DH domains. The AT domains identified in both NysB modules display features characteristic for the methylmalonylCoA-specific AT domains (Haydock et al., FEBS Lett., v. 374: 246-248, 1995). This feature of the NysB protein suggests that it comprises 1st and 2nd modules involved in the nystatin polyketide backbone biosynthetic pathway, as the only two proximal methylmalonyl CoAs incorporated in nystatin molecule are the first two extender units. NysC protein of 11096 aa, the largest, to our knowledge, bacterial polypeptide discovered so far, is composed of 6 modules apparently responsible for the condensation steps 3 to 8 in nystatin polyketide chain biosynthesis (incorporation of C21-C32). Module 5 of the NysC protein contains an ER domain, which is accountable for the reduction of the double bond between C29 and C28 (see FIG. 1). Besides module 5, all other modules in NysC are similar in that they all contain KS, AT, DH, KR and ACP domains. It was noticed that KR domains in modules 4 and 5 are 100% identical on the aa sequence level, and 99.9% identical at the level of DNA sequences encoding these domains. Thus, KR domains in modules 4 and 5 most probably represent an example of a relatively recent duplication in the process of evolution. NysI C-terminally truncated protein of 7066 aa, for which aa sequence information at the C-terminus is still missing, is composed of at least 4 complete modules. All these modules contain KS, AT, DH, KR and ACP domains, but the DH domains in three modules are apparently inactive, suggesting that the known part of NysI PKS is responsible for the elongation steps 9 through 12 (incorporation of C13-C20). This assumption is further supported by the fact that the AT domain in module 11 (based on sequence similarity) is specific for methylmalonylCoA extender, while all other AT domains in NysA, NysC and NysI are malonyl CoA-specific. Thus, the AT domain in module 11 is presumably responsible for the occurrence of the methyl group at C16 on the nystatin polyketide backbone, which is later oxidized to give a C16-coupled carboxyl (see FIG. 1).

Downstream of the nysC gene, a coding sequence nysE for thioesterase, presumably responsible for the release of mature polyketide chain from the nystatin PKSs, was found. The nysR1, nysR2 and nysR3 genes, were found downstream of nysE. The products of these genes are homologous to the presumed transcriptional regulators. NysR1 (966 aa), NysR2 (953 aa), and NysR3 (927 aa) proteins were all found to contain putative helix-turn-helix (HTH) DNA binding motifs of LuxR type at their C-termini. Beside that, NysR1 contained a distinct ATP/GTP binding motif; and NysR3 contained a "leucine zipper" (putative DNA binding) motif at their N-termini. The gene encoding NysR1 was found to contain a rare TTA codon (for Leu11) close to the beginning of the gene, suggesting that NysR1 expression might be regulated in S. noursei at the level of translation by a bldA-like gene (White & Bibb, J. Bacteriol, v. 179: 627-633, 1997).

In order to confirm the involvement of nysR1 gene in the nystatin biosynthesis a gene disruption experiment was performed with the use of a 1379 bp ApaI DNA fragment internal for the nysR1 coding sequence. The 1379 bp ApaI DNA fragment internal for the nysR1 coding sequence and representing nt 51531-52910 of SEQ ID NO 1 was cloned into the ApaI site of the pGEM11Zf(−) vector, giving the recombinant plasmid pNRD1. The 1430 bp EcoRI/HindIII DNA fragment isolated from pNRD1 was ligated with the 3.0 kb EcoRI/HindIII fragment of pSOK201 resulting in the pNRD2 vector. The latter was subsequently used for nysR1 gene disruption in S. noursei ATCC11455 via conjugation from E. coli ET12567 (pUZ8002).

Analysis of the nystatin production by the nysR1 disruption mutant revealed that it is not capable of producing nystatin. It shall be noted, however, that the phenotype observed for the nysR1 disruption mutant, might reflect the polar effect of mutation on the nysR2 and nysR3 genes, which can be co-transcribed with nysR1.

Downstream of nysR3, the genes nysR4, nysR5, ORF1, and ORF2 were found. The nysR4 gene product of 210 aa (this has subsequently found to be 266 aa expression from an upstream start codon at nucleotide 120628 in SEQ ID No. 35) shows similarity to transcriptional activators of response regulator type, and contains centrally located ATP/GTP binding and C-terminally located LuxR-type HTH DNA binding motifs. NysR5 protein of 253 aa displays similarity to the transcriptional repressors, and contains a putative DeoR-type HTH DNA binding motif at its N terminus. It seems likely that nysR4 and nysR5 gene products are involved in regulation of nystatin biosynthesis based on their location proximal to the nystatin biosynthesis genes. ORF2, located downstream of nysR5, and transcribed in the opposite direction, encodes a 354 aa peptide showing similarity to transcriptional activators and having centrally located putative HTH DNA binding motif of AsnC type. Whether this gene is involved in regulation of nystatin biosynthesis is not apparent, as ORF1, located immediately upstream of ORF2, encodes a putative peptidase. It seems likely that ORF2 is rather involved in regulation of ORF1, but to confirm this, experimentation on ORF2 inactivation is required. The fact that the gene encoding a peptidase, for which no role in nystatin biosynthesis could be assigned, was found on the right flank of the sequenced region, suggests that the right border of the nystatin biosynthesis gene cluster had been identified.

On the left flank of the sequenced region encompassing the genes described above, two genes located upstream of nysA, and transcribed in the direction opposite to nysA were identified (FIG. 4). The nysD1 gene product of 506 aa displays considerable homology to the UDP-glucuronosyltransferases from mammals. This enzyme belongs to the UDP-glycosyltransferase family, and takes part in the process of elimination of potentially toxic xenobiotics by the way of their glycosylation. It seems likely that NysD1 represents a glycosyltransferase responsible for the attachment of the deoxysugar moiety (mycosamine) to the nystatin polyketide backbone. The product of nysD2 shows a high degree of homology to the perosamine synthetases and transaminases responsible for the attachment of amino groups to the deoxysugars in the process of their biosynthesis. Thus, NysD2 presumably represents an aminotransferase involved in mycosamine biosynthesis.

Beside nysI encoding PKS type I, four other genes were identified within the second sequenced region (SEQ ID NO. 2) of the nystatin biosynthesis gene cluster of S. noursei ATCC11455 (FIG. 4). The 344 aa protein encoded by the nysD3 gene is highly homologous to the GDP-mannose-4,6-dehydratases required for deoxysugar formation. It is thus likely that the NysD3 protein is involved in biosynthesis of the nystatin mycosamine moiety in S. noursei ATCC11455. nysH and nysG gene products of 584 aa and 605 aa, respectively, display a high degree of similarity to transporters of the ABC family. Both NysH and NysG polypeptides contain a distinct ABC transporter signature at their C-termini, centrally located ATP/GTP binding motifs, and N-terminally located transmembrane regions. These two proteins most probably are responsible for the ATP-dependent active efflux of nystatin from the producing organism, thus eliminating the danger of membrane clogging by the hydrophobic nystatin molecules. The product of the nysF gene, a 245 aa polypeptide, displays homology to the 4'-phosphopantetheine transferases. The latter enzyme is responsible for the post-translational modification of the ACP domains of the PKSs, and is required for its full functionality (Cox et al., FEBS Lett., v. 405: 267-272, 1997; Kealey et al., Proc. Natl. Acad. Sci. USA, v. 95: 505-509, 1998). It seems likely, therefore, that the NysF protein functions in post-translational modification of nystatin PKSs, and is required for nystatin biosynthesis.

EXAMPLE 2

Genetic Manipulation of the Nystatin PKS Genes Leading to Production of Novel Polyene Antibiotics Nystatin belongs to the group of the polyene macrolide compounds, which are characterized by having 3 to 8 conjugated double bonds in their macrolactone ring. Nystatin itself is a tetraene, having 4 conjugated double bonds between C20 and C27. There is also a set of 2 conjugated double bonds on the nystatin molecule, between C30 and C33, which is separated from the set of 4 conjugated double bonds by C28-C29 (see FIG. 1). From the computer-assisted analysis of the NysC PKS it became apparent that the ER domain in module 5 in this protein is responsible for reduction of the double bond between C28 and C29. Thus, by inactivating this particular domain, it is theoretically possible to obtain a compound with a double bond between C28 and C29, thus joining two sets of conjugated double bonds in the nystatin molecule, and creating a heptaene macrolide compound.

To inactivate the ER domain in module 5 of NysC, the method of "in-frame" deletion within the nysC gene was chosen. The construction of the vector pERD4.2 for gene replacement in the NysC-encoding genomic region of *S. noursei* was as follows:

Inactivation of ER Domain in Module 5 of NysC

PCR-assisted amplification of the 394 bp DNA fragment representing the coding sequence for the C-terminal part of the ER domain in module 5 of NysC, and the coding sequence for the N-terminal part of the KR domain in module 5 (nt 32174-32559), was performed. The oligonucleotide primer ERD1 (5'-GTTGGTACCCCACTCCCGGTCCGCAC-3', sense) (SEQ ID NO. 25) was selected from the nucleotide sequence of nysC gene comprising nt 32174-32190 (SEQ ID NO. 1) with additional nucleotides on the 5' end in order to create a KpnI restriction enzyme cleavage site. The oligonucleotide primer ERD2 (5'-CCAGCCGCATGCACCACC-3', antisense (SEQ ID NO. 26)) was selected from the nysC coding DNA sequence, and comprised the DNA segment between nt 32559-32542 (SEQ ID NO. 1) containing a SphI restriction enzyme cleavage site. The resulting PCR fragment was digested with KpnI and SphI, and ligated together with the 1828 bp BamHI/KpnI DNA fragment (nt 29224-31052 of SEQ ID NO. 1), and the 1273 bp SphI/EcoRI DNA fragment (nt 32548-33821 of SEQ ID NO. 1) into the EcoRI/BamHI—digested pGEM3Zf(-) vector. The ligation mixture was transformed into the *E. coli* DH5α, and recombinant plasmid of 6.7 kb designated pERD4.1 was recovered from one of the transformants. The latter contained a hybrid DNA fragment representing nt 29224-33821 of the SEQ ID NO. 1 DNA sequence with internal deletion between nt 31052 and nt 32174 of the nysC coding region. This deletion eliminated the coding regions (aa 4837 to 5208 of nysC) for the part of the DH-ER interdomain linker and C-terminal part of the ER domain containing a putative NADP(H) binding site.

To construct the vector for inactivation of NysC ER4 domain in *S. noursei*, the recombinant DNA fragment was excised with EcoRI and HindIII restriction enzymes from pERD4.1 and ligated with the 3.0 kb EcoRI/HindIII DNA fragment from pSOK201, and the ligation mixture was transformed into the *E. coli* DH5α. Plasmid pERD4.2 of 6.5 kb was isolated from one of the transformants and used to perform the gene replacement procedure in *S. noursei* ATCC11455 (see below). The recombinant *S. noursei* strains selected after this procedure were designated ERD44 and ERD48.

The latter plasmid was introduced into *S. noursei* ATCC11455 by intergeneric conjugation, and one transconjugant, *S. noursei* (pERD4.2), was chosen for further manipulations. After the correct mode of integration of pERD4.2 into the genome of the *S. noursei* (pERD4.2) was confirmed by Southern blot analysis, selection for the second crossover event was carried out as described in Sekurova et al., FEMS Microbiol Lett, v. 177: 297-304, 1999 (and see below).

Gene Replacement Procedure

This method is carried out as described by Sekurova et al., 1999, supra.

The plasmid constructed for gene replacement as described above was introduced into *S. noursei* by conjugation from the *E. coli* ET 12567 (pUZ8002). One of the clones carrying the plasmid integrated into the chromosome via homologous recombination was subjected to three rounds of sporulation on antibiotic-free ISP2 agar medium, and the progeny after the third round was tested for the loss of antibiotic resistance marker. Southern blot analysis of the total DNA isolated from several antibiotic-sensitive strains with an appropriate probe was used to confirm the desired mutation.

Figure 6:
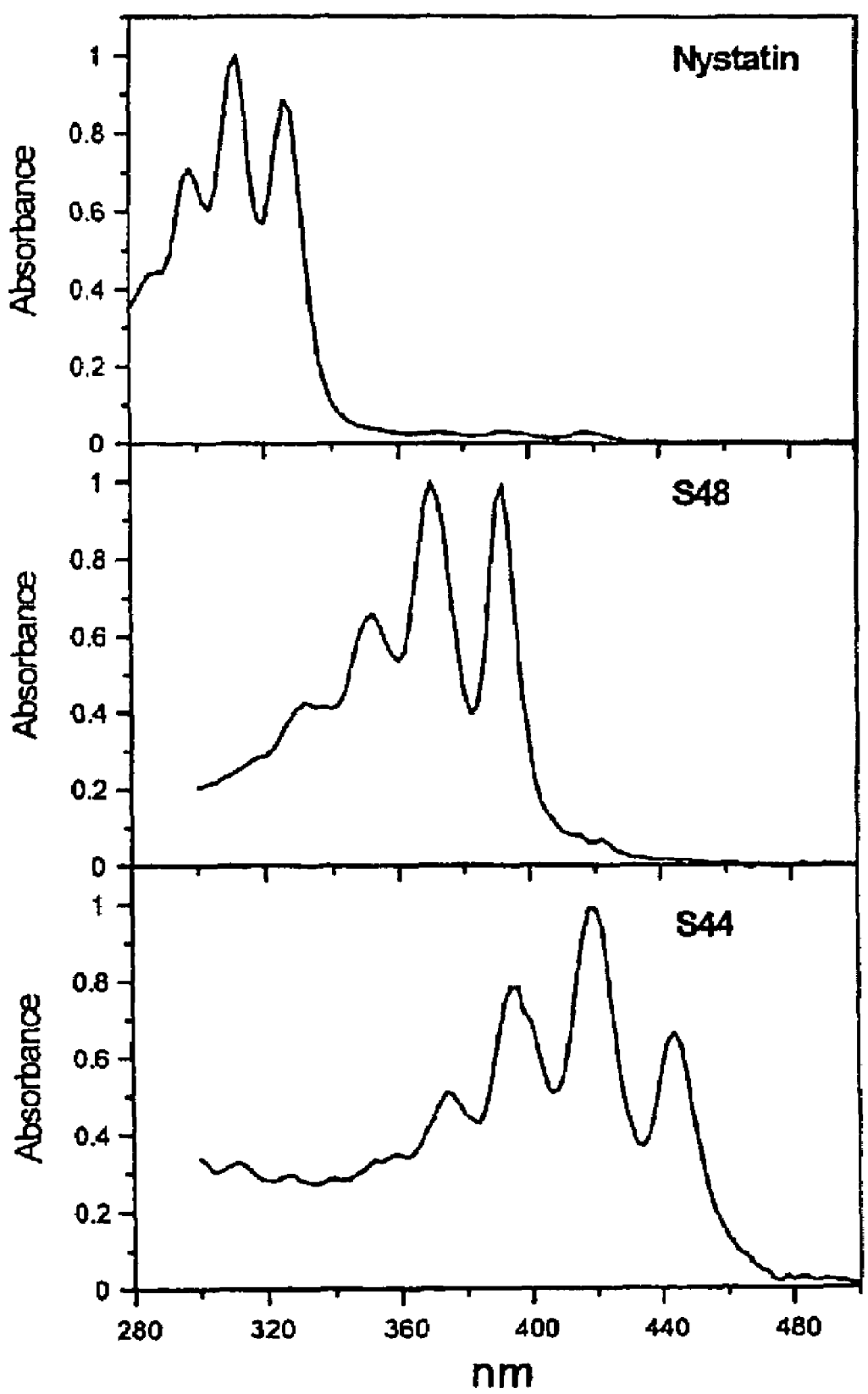
FIG. 6 shows the UV spectra (in DMSO) for nystatin and new polyene compounds S44 and S48 obtained from recombinant *S. noursei* strains with genetically altered NysC PKS (see Example 2)

Of 8 colonies, which had lost the selection marker, and thus undergone a second crossover event, 4 were shown by Southern blot analysis to have reverted to the wild-type genotype. Two strains were shown to contain a large deletion apparently eliminating a substantial portion of the nystatin gene cluster, while two other mutants contained either the desired 1116 bp deletion (ERD44), or a deletion which was somewhat larger than expected (ERD48). Analysis of the polyene antibiotic production by the strains ERD44 and ERD48 revealed that they do not produce nystatin. Instead, ERD44 was shown to produce a polyene compound having UV spectrum peaks characteristic for heptaens (FIG. 6), as expected. Surprisingly, the ERD48 mutant was shown to produce hexaenic polyenes (according to spectroscopic analysis), which would be consistent with "in-frame" deletion of the complete module 5 from the NysC protein. In order to investigate the event which occurred in the ERD48 mutant in more detail, the DNA fragment was PCR-amplified from the genome of *S. noursei* ERD48 mutant, which would encompass the putative product of such deletion (see below).

PCR-Assisted Amplification and Cloning of the PKS-Encoding DNA Fragment from the *S. noursei* ERD48 Genome The PCR reaction aimed at amplification of part of the mutant nysC gene in *S. noursei* ERD48 was carried out with oligonucleotide primers KR48.1 (sense, 5'-CCG CGT CGG ATC CGC CGA C-3') (SEQ ID NO: 27) and KR48.2 (antisense, 5'-AGC CTT CGA ATT CGG CGC C-3') (SEQ ID NO: 28) which corresponded to the nt 24744-24760 and nt33818-33833, respectively, of the DNA sequence in SEQ ID NO. 1. The 50 μl PCR mixture contained 0.1 μg of *S. noursei* ERD48 total DNA, 25 pm of each KR48.1 and KR48.2 oligonucleotide primers, dNTPs (final concentration 350 μm), 1×PCR buffer from Expand High Fidelity PCR System (Boehringer Mannheim) and 1.5 U of the DNA polymerase mixture from the same system. The PCR was performed on the Perkin Elmer GeneAmp PCR System 2400 with the following program: 1 cycle of denaturation at 96° C. (4 min), 35 cycles of denaturation/annealing/synthesis at 94° C. (45 sec) and 70° C. (10 min) and 1 full cycle of final annealing/extension at 72° C. (10 min). The 2.7 kb DNA fragment obtained with this procedure was digested with EcoRI and BamHI restriction enzymes, and ligated with pGEM3Zf(-) vector DNA digested with the same enzymes. The ligation mixture was introduced into *E. coli* DH5α by transformation, the plasmid pKR48 of 5.9 kb was isolated from one of the transformants and subjected to DNA sequence analysis.

The DNA sequence of the insert in pKR48 is present in SEQ ID NO. 29, (identified herein as ERD48 seq). The translation product is shown in SEQ ID NO. 30 and is a 899 aa protein—the molecule features of SEQ ID NOs 29 and 30 respectively are shown below:

| Start | End | Name | Description |
|---|---|---|---|
| SEQ ID NO: 29 (DNA; ERD48.seq) | | | |
| 1 | 254 | DH4 | DH4 domain coding region, C-terminal |
| 1170 | 1913 | KR4/5 | hybrid ketoreductase domain, module 4/5 |
| 2010 | 2231 | ACP5 | ACP5 domain coding region |
| 2295 | 2700 | KS5 | KS5 domain coding region |

-continued

| Start | End | Name | Description |
|-------|-----|------|-------------|
| SEQ ID NO: 30 (AA; translation product) | | | |
| 1 | 84 | DH4 | DH4 domain module 4, C-terminus |
| 390 | 637 | KR4/5 | hybrid KR domain |
| 670 | 743 | ACP5 | ACP domain, module 5 |
| 764 | 899 | KS5 | KS domain, module 5, N-terminus |

The cloning and DNA sequencing of this 2700 bp fragment confirmed that it encodes a part of a hybrid PKS module, which would be consistent with recombination between DNA sequences encoding highly homologous KR domains in modules 4 and 5 of NysC. This recombination apparently has led to deletion of DNA sequences encoding C-terminal parts of KR and ACP domains of module 4, and KS, AT, DH, ER domains, and N-terminal part of the KR domain of module 5, thus resulting in the loss of one complete module from NysC PKS.

Preliminary analysis of the compounds produced by the S. noursei ERD44 and ERD48 was carried out. It was shown that a heptaenic compound produced by the ERD44 mutant has high antifungal activity against Candida albicans, an organism used in tests for antifungal activity. At this point it is not possible to accurately assay the activity of this compound (tentatively named S44), because it is not yet properly purified, and its exact concentration is difficult to estimate. However, some rough estimates based on the UV absorbance at the wave lengths characteristic for nystatin, S44, and amphotericin (a heptaenic macrolide), suggest that S44 might have 4-5 times higher antifungal activity compared to nystatin. HPLC analysis of the compounds produced by the ERD48 mutant suggests that at least 5 hexaenic macrolides with different retention times are produced by this strain (mixture called S48). This probably reflects the different states of modifications of the macrolactone ring by i.e. glycosylation at C19, hydroxylation at C10, or oxidation of the methyl group at C16. This could have been expected, since reduction of the macrolactone ring size most probably leads to the lower affinity of the modifying enzymes towards the new substrate.

Figure 5:
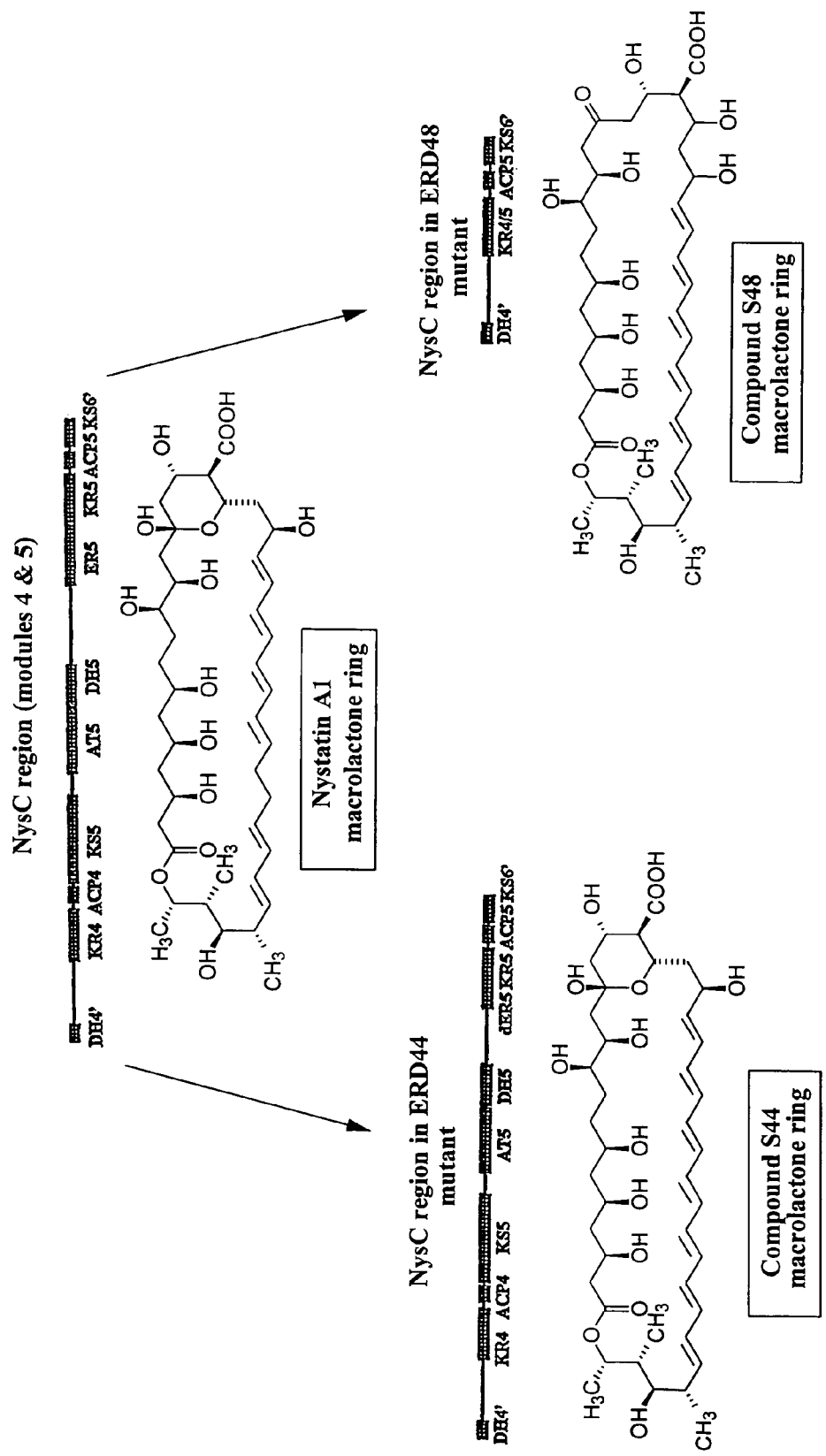
FIG. 5 is a schematic representation showing genetic manipulations of the module 5 in NysC PKS leading to production of new polyene compounds by recombinant *S. noursei* strains (see Example 2)

Antifungal activity of the S48 mixture was tested, and found to constitute approx. 10% of nystatin activity. It seems probable that only one of the compounds in the S48 mixture produced by ERD48, which is fully decorated by the ring-modifying enzymes, is responsible for the antifungal activity detected. Thus, relative antifungal activity of this compound is impossible to assess prior to its purification. Some of the hexane antibiotics are known to have antibacterial, as well as antifungal activity (Ciftci, et al., J. Antibiot, v. 37: 876-884, 1984). It is thus possible that hexaenic compounds produced by the ERD48 mutant can be used for production of antibacterial agents. The changes in the NysC protein leading to production of new polyene compounds in ERD44 and ERD48 mutants, along with the predicted structures of their macrolactone rings are presented in FIG. 5.

Inactivation of DH8 Domain in Module 8 of NysC

The possibility of genetically manipulating the nystatin PKS was further exemplified by inactivation of the DH domain in module 8 of NysC. The plasmid pNPR1.1 for gene replacement within nysC gene, which would result in in-frame deletion of the DNA region encoding DH8 domain was constructed as below:

The 3989 bp KpnI/BclI DNA fragment (nt 43004-46993 of the region 1 DNA sequence (SEQ ID NO. 1) and the 2409 bp BamHI/EcoRI DNA fragment (nt 47680-50089 of the same) were excised from the DNA of recombinant phage N1 and ligated with vector pGEM3Zf(-) DNA digested with EcoRI and KpnI. The ligation mixture was transformed into E. coli DH5α, and recombinant plasmid pGEM-NPR1 was isolated from one of the transformants. The latter contained the hybrid DNA fragment representing the nt 43004-50089 of the region 1 DNA sequence (SEQ ID NO:1) with the internal deletion between nt 46993 and nt 47680. This deletion eliminated the DNA region encoding the aa 10150 to 10378 of the NysC polypeptide, thus affecting the DH8 domain in module 8, and DH8-KR interdomain linker in module 8. To construct the vector for inactivation of the NysC DH8 domain in S. noursei, the recombinant DNA fragment was excised with EcoRI and HindIII restriction enzymes from pGEM-NPR1 ligated with the 3.0 kb EcoRI/HindIII DNA fragment from pSOK201 (see FIG. 3 and Table 3) and the ligation mixture was transformed into the E. coli DH5α. Plasmid pNPR1.1 of 9.4 kb was isolated from one of the transformants and used to perform the gene replacement procedure in S. noursei ATCC11455 according to Sekurova et al., 1999, supra.

The recombinant S. noursei strain selected after this procedure was designated NPR1.1 The S. noursei NPR1.1 recombinant strain was shown by Southern blot analysis to contain the desired deletion in the DH8-coding sequence of nysC. Analysis of the secondary metabolites in the culture extracts of the S. noursei NPR1 recombinant strain by thin layer chromatography (TLC) revealed the presence of presumed macrolide compounds. The relative mobility of these compounds differed from nystatin, and no UV spectra characteristic for nystatin could be detected in the extracts. It was suggested, that in the new molecule(s) produced by the NPR1 recombinant a set of 4 double bonds on the nystatin aglycone has been disturbed, and that the macrolactone ring now contains a hydroxy group attached at C23 (Table 5). No attempts to purify the compound(s) from NPR1 were made, as the bioassay against Candida albicans made with the NPR1 culture extracts showed very low antifungal activity. However, the NPR1 mutant can be potentially useful for further manipulations with the nystatin PKS.

Inactivation of KR Domain in Module 7 (NysC)

The 4404 bp DNA fragment was excised with EcoRI and SmaI restriction enzymes from the DNA of recombinant phage N1. The EcoRI site is situated in the polylinker of phage N1 to the left of the S. noursei DNA insert starting at nt 38398 of the region 1 DNA sequence (SEQ ID NO. 1), while the SmaI site corresponds to nt 42802 of the region 1 DNA sequence. The 3303 bp DNA fragment was excised with SmaI and BamHI restriction enzymes from the DNA of the same recombinant phage. The SmaI and BamHI restriction sites are situated at nt 43099 and nt 46402 respectively, of the region 1 DNA sequence (SEQ ID NO. 1). Both DNA fragments were ligated with the pGEM3Zf(-) DNA digested with restriction enzymes EcoRI and BamHI, and the ligation mixture was transformed in Escherichia coli DH5α. The plasmid pGEM-NPR2 of 10.7 kb was recovered from one of the transformants, which contained a recombinant DNA fragment which represented nt 38398-46402 of the region 1 DNA sequence (SEQ ID NO. 1) with the internal deletion between nt 42802 and nt 43099. This deletion results in elimination of the DNA region encoding aa 8753 to 8851 of the NysC protein encompassing a putative NADP(H) binding site in the KR domain of module 7. To construct the vector for inactivation of NysC KR7 domain in S. noursei, the recombinant DNA fragment was excised from pGEM-NPR2 with EcoRI and HindIII restriction enzymes, and ligated with the 3.0 kb EcoRI/HindIII DNA fragment from pSOK201, and the ligation mixture was transformed into the *E. coli* DH5α. Plasmid pNPR2 of 10.7 kb was isolated from one of the transformants and used to perform the gene replacement procedure in *S. noursei* ATCC11455 (according to Sekurova et al., 1999, supra). The recombinant *S. noursei* strain selected after this procedure was designated NPR2.1.

Analysis of the secondary metabolites in the culture extracts of the *S. noursei* NPR2.1 recombinant strain by TLC revealed the presence of presumed macrolide compounds. The relative mobility of these compounds differed from nystatin, and from the metabolites produced by NPR1 mutant. No UV spectra characteristic for nystatin could be detected in the extracts. It is suggested, that in the new molecule(s) produced by the NPR2.1 recombinant a set of 4 double bonds on the nystatin aglycone has been disturbed, and the macrolactone ring now contains a keto group at C25 (Table 5). No attempts at purification of the compound(s) from NPR2.1 were made, and no bioassays for antifungal activity with the NPR2.1 culture extracts were performed. This mutant has utility not only by virtue of the metabolites it produces, but also for further manipulation with nystatin PKS.

Inactivation of the ER Domain in Module 5 of the Mutated NysC Protein NysC_DH8)

To introduce the second mutation into the NysC protein with inactivated DH domain in module 8 (NysC_DH7), the plasmid pERD4.2 was introduced into the *S. noursei* mutant NPR1.1 and the gene replacement procedure was carried out as described in Sekurova et al., 1999, supra. This yielded recombinant *S. noursei* strain ERDH9 with mutations in both ER5 and DH8 coding sequences of nysC. The combination of these two mutations presumably leads to biosynthesis of the pentaenic nystatin derivative with a hydroxy group at C23 (Table 5). Preliminary analysis of the ERDH9 culture extracts confirmed that a polyene compound(s) is being produced by this strain although in quantities making identification of its true UV spectrum difficult. The preliminary data also show that this compound is preferentially accumulated in the culture supernatant, while nystatin produced by the wild-type *S. noursei* remains mostly associated with mycelium. This was consistent with the hypothesis that an additional hydroxy group on the nystatin molecule is responsible for increased water solubility of the compound(s). No attempts at purification of this new compound(s) were made, and no bioassays were performed.

To date, the Inventors have been unable to confirm the structure of the products of mutants NPR1.1; NPR2.1 and ERDH9.

TABLE 5

Predicted structures of nystatin derivatives produced via genetic engineering of nysC gene in *S. noursei*

(see Example 2 for details)

| Mutant | Expected structure (polyketide moiety only) | UV spectrum nm (DMSO) | Activity |
|---|---|---|---|
| ATCC 11455 | nystatin (FIG. 1) | 299,312,327 | normal |
| ERD44 | 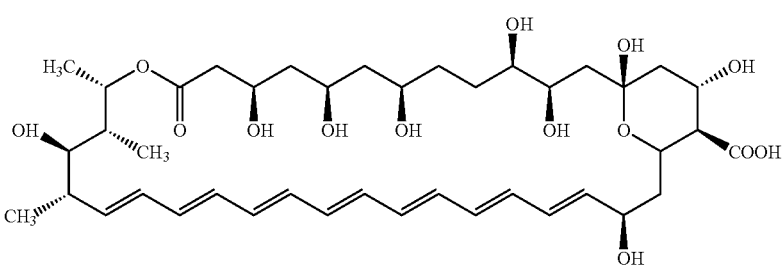 | 375,395,419,444 | high |
| ERD48 | 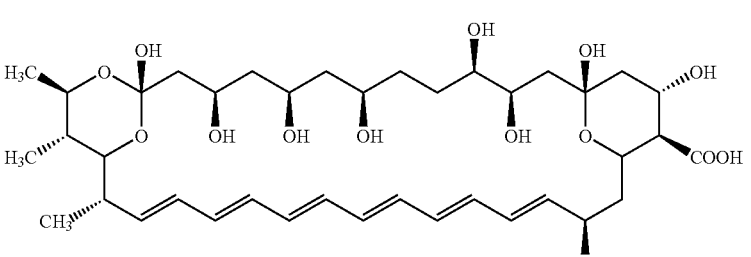 | 336,352,370,391 | low? |

TABLE 5-continued

Predicted structures of nystatin derivatives produced via
genetic engineering of nysC gene in *S. noursei*
(see Example 2 for details)

| Mutant | Expected structure (polyketide moiety only) | UV spectrum nm (DMSO) | Activity |
|--------|---------------------------------------------|----------------------|----------|
| NPR1 | | | low |
| NPR2.1 | | | ? |
| ERDH9 | | ? | ? |

EXAMPLE 3

Manipulation of the Regulatory Genes Leading to Increased Production of Nystatin Expression of nysR1 Under the Control of PermE* Promoter in *S. noursei* ATCC11455

Figure 2:
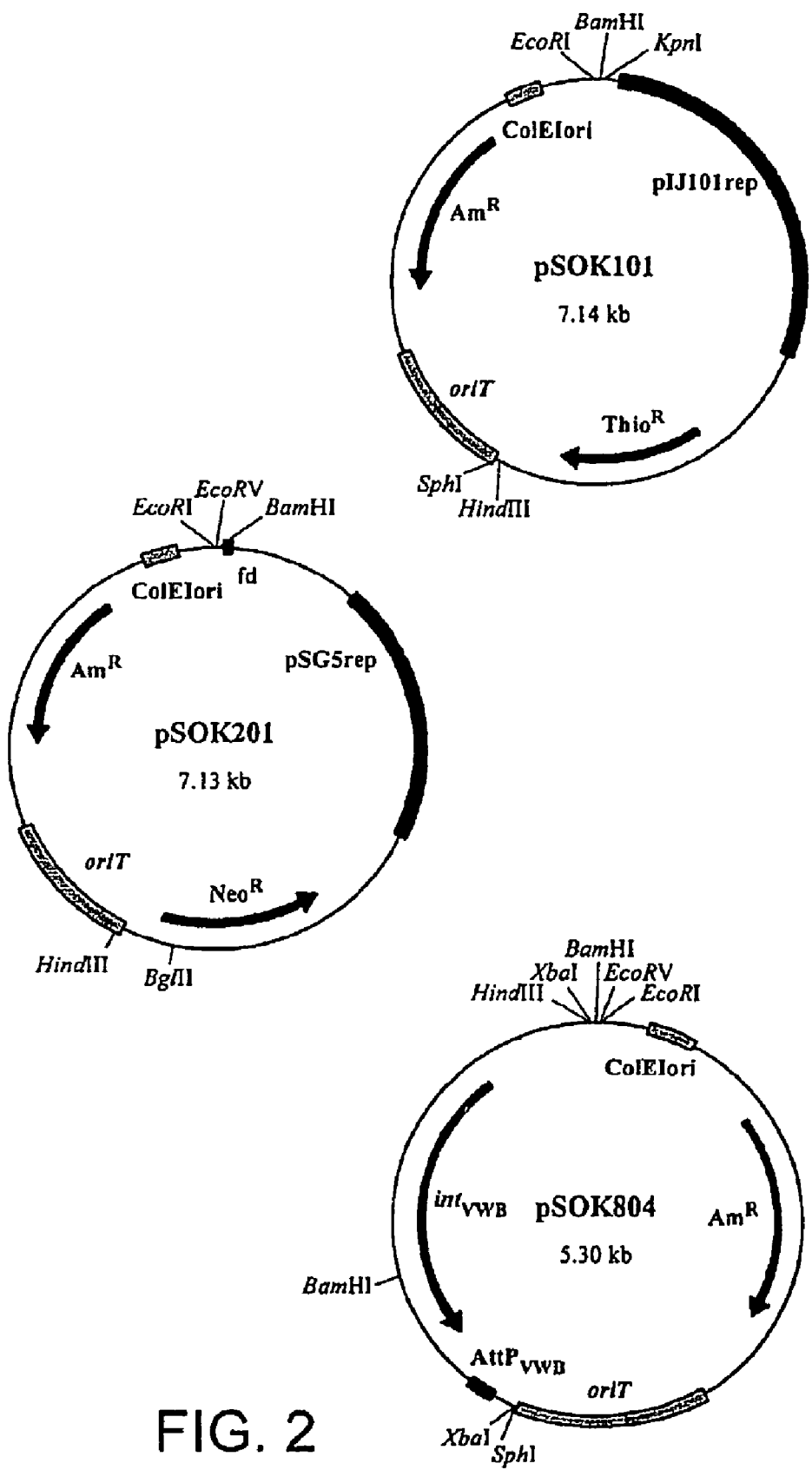

To further confirm that nysR1 gene encodes a transcriptional activator of the nystatin biosynthesis genes, the latter was expressed in *S. noursei* ATCC11455 under the control of the PermE* promoter (Bibb et al., Mol. Microbiol., v. 14: 433-545, 1994). First, the plasmid pSOK804 for stable and efficient integration into the *S. noursei* ATCC11455 genome was constructed (FIG. 2). This was made by ligating together the 3.0 kb SphI/HindIII DNA fragment from pSET152 (Bierman et al., 1992, supra) and 2.3 kb SphI/HindIII fragment from bacteriophage VWB carrying functions necessary for site-specific integration (Van Mellaert et al., 1998, supra). Conjugation of pSOK804 from *E. coli* ET12567 (pUZ8002) into *S. noursei* ATCC1455 demonstrated that this plasmid integrates specifically into one site of the *S. noursei* genome at a frequency of $3 \cdot 10^{-6}$.

To clone the nysR1 gene under PermE* promoter in pSOK804, the following procedure was employed. The N-terminal part of nysR1 was PCR-amplified from the recombinant phage N1 DNA template with the oligonucleotide primers NR1.1 (sense) 5'-CGCCGCATGCTGTTCT-CACCCCACGT-3' (SEQ ID NO: 31), and NR1.2 (antisense): 5'GGCGCGACCCGGTTCGGCCT-3' (SEQ ID NO: 32). The oligonucleotide primer NR1.1 sequence corresponded to the nt 51376-51391 of SEQ ID NO: 1 with addition of nucleotides CGCCGCATGC (SEO ID NO: 49) at the 5' end to create a site for SphI endonuclease. The oligonucleotide primer NR1.2 corresponded to the sequence complementary to nt 51964-51982 of SEQ ID NO: 1, and encompassed a restriction site for AgeI endonuclease. A 0.6 kb fragment was PCR-amplified using the phage N1 DNA as a template under conditions described in Example 1, and digested with SphI and AgeI. The digested 0.6 kb fragment was ligated together with a 2.8 kb AgeI/EcoRI DNA fragment from the phage N1 insert (EcoRI site originating from the phage's polylinker) into pGEM7Zf(–) vector digested with SphI and EcoRI. The 2.8 kb fragment used in this ligation corresponded to nt 51971-54814 of SEQ ID NO: 1, and encompassed the C-terminal part of nysR1 and N-terminal part of nysR2 (encoding the first 162 aa of NysR2). The recombinant plasmid obtained as a result of this ligation was designated pNRE1. The 3.5 kb SphI/HindIII DNA fragment from pNRE1 was ligated together with the 0.3 kb EcoRI/SphI fragment from pGEM7ermELi (see Table 3) containing PermE* promoter into pSOK804 vector digested with EcoRI/HindIII. The resulting plasmid, pNRE2, was introduced into the *S. noursei* ATCC11455 by conjugation (see Example 1) yielding recombinant strain *S. noursei* (pNRE2). Analysis of the nystatin production by the latter strain in shake-flasks with reduced glucose medium revealed that it produces 50% more 20 nystatin compared to the wild-type strain, most likely due to overexpression of the nysR1 gene from the PermE* promoter. It therefore appears that nysR1 gene encodes a positive activator that may be used for enhancing the production of nystatin and its derivatives in *S. noursei* strains.

Partial Deletion of nysR5 Gene in the *S. noursei* ATCC11455

To confirm the function of the nysR5 gene predicted through analysis of its coding DNA sequence (see Example 1) in the regulation of nystatin biosynthesis, a specific mutation in *S. noursei* ATCC11455 genome was introduced. A DNA fragment from the *S. noursei* ACTT11455 genome encompassing nt 62037-63360 of the nucleotide sequence reported here was amplified by PCR with the primers NR5D1 (5'-GCGAGCGGCCGCTTCACCCCGCAACTCA-3') (SEQ ID NO: 33) and NR5D2 (5'-CGCGAAGCTTGGCCGACT-GCTCGACGTC-3') (SEQ ID NO: 34). The conditions for PCR were as described above. The 1341 bp PCR product was digested with NotI and HindIII, and ligated with the 1688 bp EcoRI/NotI DNA fragment (nt 60301-61989) and 3.0 kb EcoRI/HindIII fragment from pSOK201. The resulting plasmid, pNR5D, contained the *S. noursei* DNA fragment with a 43 bp deletion in the coding region of nysR5 gene. This deletion creates a frame-shift mutation within the nysR5 coding region, subsequently leading to truncation of its product. As a result of such truncation, 165 C-terminal amino acids of NysR5 are eliminated, and replaced with 14 amino acids encoded by another reading frame (and thus unrelated to NysR5). The pNR5D plasmid was used to perform a gene replacement procedure in *S. noursei* ATCC11455 as described in Sekurova et al., 1999, supra.

The mutation introduced through gene replacement led to a 5-15% increase in nystatin production by the resulting recombinant strain NR5D, compared to the wild-type *S. noursei*. Subtle but reproducible positive effect of NysR5 C-terminal deletion on nystatin biosynthesis correlates well with the putative repressor function assigned to this protein based on computer analysis (see Example 1). Since the deletion introduced in the nysR5 gene does not eliminate the N-terminally located putative helix-turn-helix motif identified in this protein, the residual repressor activity of the truncated NysR5 polypeptide could account for the relatively small effect of this mutation on nystatin production. Nevertheless, this result confirms the usefulness of introducing mutations in the repressor-encoding gene as further means for enhancing the production of nystatin and its derivatives.

EXAMPLE 4

Completion of the Sequencing of the Nystatin Biosynthesis Gene Cluster

The DNA sequence spanning the gap between SEQ ID No. 1 and SEQ ID No. 2 was determined for both DNA strands on the overlapping inserts in recombinant phages N20, N32, N95, N98, and N99 covering this region.

Procedures used for sequencing, probe generation and screening were as described in Example 1. The probes used for library screening, and the relevant recombinant phages discovered were as follows:

| PKS 72    | N20, N32 |
|-----------|----------|
| L44ES3.5  | N90      |
| L76SN0.5  | N95      |
| L20S0.64  | N98, N99 |

Description of the Probes:
6. L44ES3.5 probe. The 3.5 kb DNA fragment isolated from the phage N44 with restriction enzymes EcoRI and SalI, was used as a L44ES3.5 probe.
7. L76SN0.5 probe. The 0.5 kb DNA fragment isolated from the recombinant phage N76 with restriction enzymes SacI and NotI, was used as a L76SN0.5 probe.
8. L20S0.64 probe. The 0.64 kb DNA fragment isolated from the plasmid pL20EB3.7 with the restriction enzyme SalI, was used as a L20S0.64 probe.

New sequence information resulted in identification of complete nysI and nysDII genes, as well as the new genes nysJ, nysK, nysL, nysM, and nysN (see FIG. 7). According to the new information, the NysI protein of 9477 aa (SEQ ID No. 37) represents a PKS composed of six modules, responsible for the elongation steps 9 to 14 of the nystatin polyketide backbone biosynthesis. All these modules contain KS, AT, DH, KR and ACP domains. The presence of a mAT domain in module 11 is consistent with incorporation of methylmalonyl-CoA extender at this elongation step. The DH domains in modules 10, 11, 12, and 14 seem to be inactive due the absence of the active site motif $H(X_3)G(X_4)P$. The KR domain in module 13 of NysI lacks the conserved motif aSRrG, and thus appears to be inactive. The latter feature, together with an inactive DH domain in module 11, most probably account for the presence of a six-membered ketalic ring (between C13 and C17) on the nystatin molecule.

The nysJ gene encoding a PKS, is located downstream of nysI, and is transcribed in the same direction. As judged from the organisation of modules in NysJ (SEQ ID No. 38), the latter is required for the elongation steps 15 to 17 in the nystatin macrolactone ring assembly. The DH domains in modules 16 and 17 within NysJ seem to be inactive, and the ER domain localized in module 15 is most probably responsible for the reduction of a double bond between C8 and C9.

The last, 18$^{th}$ module in the nystatin PKS system is represented by the NysK protein (SEQ ID No. 39) encoded by the nysK found downstream of nysJ. The NysK protein of 2066 aa is composed of KS, AT, inactive DM, ACP and TE domains. The NysK protein lacks a KR domain, and contains apparently inactive DH domain. A TE domain was identified at the C-terminus of NysK, suggesting that in addition to the condensation of the last extender unit, this protein also participates in the release of the mature nystatin polyketide chain from the PKS complex.

The gene organisation of the cluster is shown in FIG. 9 and FIG. 8 sets out the proposed involvement of the various proteins encoded in the nystatin biosynthetic pathway.

To confirm the involvement of nysI, and nysJ in nystatin biosynthesis, these genes were disrupted in *S. noursei* via homologous recombination using the conjugative suicide vectors pKNI1, and pKNJ1. The construction of the above vectors for disruption experiments was as follows. A 3.8 kb EcoRI/BamHI-fragment internal for the nysI, and corresponding to nucleotides 23711-27541 of SEQ ID No. 35, was excised from N64 DNA and ligated into the corresponding sites of plasmid pGEM3Zf(−), resulting in plasmid pL64EB3.8. The *S. noursei* fragment cloned into pL64EB3.8 was excised from this plasmid with restriction enzymes EcoRI and HindIII, and ligated with the 3.0 kb EcoRI/HindIII-fragment from the vector pSOK201, resulting in plasmid pKNI1.

A 3.7 kb EcoRI/BamHI-fragment internal for nysJ, and corresponding to nucleotides 43287-46992 of SEQ ID No. 35 was excised from phage N20 DNA, and ligated into the corresponding sites of plasmid pGEM3Zf(–), resulting in plasmid pL20EB3.7. The *S. noursei* fragment cloned into pL20EB3.7 was excised from this plasmid with restriction enzymes EcoRI and HindIII, and ligated with the 3.0 kb EcoRI/HindIII-fragment from the vector pSOK201, resulting in plasmid pKNJ1. Both pKNI1 and pKNJ1 constructs were transformed into *E. coli* ET 12567 (pUZ8002), and further transferred into *S. noursei* ATCC 11455 by conjugation, as described in Zotchev et al., (2000) Microbiology 146: 611-619. No nystatin production was detected in either of the pKNI1 and pKNJ1 disruption mutants, thus confirming the requirement of the identified PKS's for nystatin biosynthesis.

Three genes encoding proteins presumably involved in modification of the nystatin molecule were identified between nysK and nysDII. Both the nysL and nysN genes encode P450 monooxygenases of 394 aa and 398 aa, respectively (SEQ ID Nos. 40 and 42 respectively), that are probably responsible for hydroxylation of the nystatin polyketide moiety at C10, and oxidation of the methyl group at C16. Which protein is responsible for which reaction is not yet clear, and additional experiments are required for exact placement of NysL and NysN in the nystatin biosynthetic pathway. The nysM gene apparently encodes a ferredoxin of 64 aa (SEQ ID No. 41), which presumably constitutes a part of one or both P450 monooxygenase systems, and serves as an electron donor [O'Keefe, D. P. & Harder, P. A. (1991). Occurrence and biological function of cytochrome P450 monooxygenases in the actinomycetes. *Mol. Microbiol.* 5, 2099-2105].

The DNA sequences extending the region depicted on FIG. 7 (SEQ ID No. 35) approximately 10 kb to the left (recombinant phage N90), and approximately 5 kb to the right (recombinant phage N69) were determined. No genes with plausible functions in the nystatin biosynthesis were found, suggesting that the entire nystatin gene cluster had been identified.

Thus, based on the complete sequence information for the nystatin biosynthetic gene cluster, the following genes are identified and their roles described as follows (see also FIGS. 8 and 9):

TABLE 6

Genes identified within the nystatin biosynthetic gene cluster of *S. noursei* ATCC 11455

| Designation | Product | Putative function |
| --- | --- | --- |
| nysF putative | 4'-phosphopantheteine transferase | post-translational PKS modification |
| nysG | ABC transporter | efflux of nystatin |
| nysH | ABC transporter | efflux of nystatin |
| nysD3 | GDP-mannose-4,6-dehydratase | mycosamine biosynthesis |
| nysI | PKS type I | nystatin PKS (modules 9-14) |
| nysJ | PKS type I | nystatin PKS (modules 15-17) |
| nysK | PKS type I | nystatin PKS (module 18 + TE) |
| nysL | P450 monooxygenase | hydroxylation at C-10 |
| nysM | ferredoxin | electron transfer in P450 system |

TABLE 6-continued

Genes identified within the nystatin biosynthetic gene cluster of *S. noursei* ATCC 11455

| Designation | Product | Putative function |
| --- | --- | --- |
| nysN | P450 monooxygenase | oxidation of methyl group at C-16 |
| nysD2 | aminortansferase | mycosamine biosynthesis |
| nysD1 | glycosyltransferase | attachment of mycosamine |
| nysA | PKS type I | nystatin PKS (loading module) |
| nysB | PKS type I | nystatin PKS (modules 1 and 2) |
| nysC | PKS type I | nystatin PKS (modules 3-8) |
| nysE | thioesterase | release of polyketide chain from PKS |
| nysR1 | transcriptional activator | regulation of nystatin production |
| nysR2 | transcriptional activator | regulation of nystatin production |
| nysR3 | transcriptional activator | regulation of nystatin production |
| nysR4 | transcriptional activator | regulation |
| nysR5 | transcriptional repressor | regulation |
| ORF2 | transcriptional activator | regulation |
| ORF1 | peptidase | peptide metabolism |

EXAMPLE 5

Manipulation of Nystatin Biosynthetic Genes

Predictive examples presented below provide guidelines for the rational genetic manipulations of the nystatin biosynthetic genes aimed at specific chemical changes in the nystatin molecule. These manipulations are based on the current understanding of structure-function relationship of the polyene antibiotics the number of conjugated double bonds and the presence of two ionisable groups (exocyclic carboxyl and aminogroup belonging to the deoxysugar moiety mycosamine).

Changing the Number and Positions of Conjugated Double Bonds.

The conjugated double bonds within the nystatin macrolactone ring are formed as a result of two reductive steps performed by a PKS modules with ketoreductase (KR), and dehydratase (DH) activities. Further reduction of the double bond can be brought about by introducing a enoylreductase (ER) activity in such PKS modules. This shall result in the formation of a completely saturated bond instead of a double bond at a specific step of nystatin biosynthesis. The following manipulations can be proposed (compounds that theoretically can be produced as a result of these manipulations are presented on FIG. 10):

insertion of ER domain into module 3 (1)
    insertion of ER domain into module 4 (2);
    simultaneous inactivation of the ER domain in module 5 and insertion of the ER domain into module 3 (3);
    simultaneous inactivation of the ER domain in module 5 and insertion of the ER domain into module 4 (4);
    simultaneous inactivation of the ER domain in module 5 and insertion of the ER domain into module 7 (5);

simultaneous inactivation of the ER domain in module 5 and insertion of the ER domain into module 8 (6);

simultaneous inactivation of the ER domain in module 5 and insertion of the ER domain into module 9 (7);

simultaneous inactivation of the ER domain in module 5 and insertion of the ER domains into modules 8 and 9 (8);

simultaneous inactivation of the ER domain in module 5 and insertion of the ER domains into modules 7 and 8 (9);

These manipulations can be performed using the techniques for gene replacement described for *S. noursei* (Sekurova et al., FEMS Microbiol Lett, 177: 297-304, 1999). The materials for manipulations can be provided by the nystatin gene cluster itself, or other PKS gene clusters. The latter could be preferential from the point of view of genetic stability of the recombinant strains.

Removal/Repositioning of the COOH Group

Exocyclic carboxyl function of the polyene antibiotics is believed to play a crucial role in selective toxicity of these compounds. More specifically, the inter- and intramolecular interactions between the ionizable exocyclic carboxyl and amino group of micosamine moiety seem to be of particular importance (Resat, H., Sungur, F. A., Baginski, M., Borowski, E., Aviyente, V. 2000. Conformational properties of amphotericin B amide derivatives—impact on selective toxicity. Journal of Computer-Aided Molecular Design, v. 14, p 689-703). It is theoretically possible to either remove the exocyclic carboxyl from, or reposition it on the nystatin moleculevia manipulation of the nystatin biosynthetic genes. Nystatin derivatives produced via such manipulations could be useful on their own, or serve as substrates for further chemical modifications.

The following manipulations are proposed (resulting compounds are represented on FIG. 11):

replacement of methylmalonyl-specific acetyltransferase (AT) domain in module 11 of the nystatin PKS with malonyl-specific AT domain (10);

replacement of malonyl-specific AT domain in module 12 with methylmalonyl-specific AT domain with simultaneous replacement of methylmalonyl-specific AT domain in module 11 with malonyl-specific AT domain (11);

replacement of malonyl-specific AT domain in module 10 with methylmalonyl-specific AT domain with simultaneous replacement of methylmalonyl-specific AT domain in module 11 with malonyl-specific AT domain (12);

inactivation of P450 monooxygenase-encoding genes nysL or nysN (whichever is found to be responsible for oxygenation of the methyl group at C-16 on the nystatin molecule) (13).

It shall be noted that specificity of the P450 monooxygenase responsible for the appearance of the exocyclic carboxyl function can be engineered so that it fulfills its function on the new substrates. Such methods as site-specific or random mutagenesis along with error-prone PCR and DNA shuffling might prove useful for this purpose.

1.3. Introduction of Additional Hydroxyl Functions (Increasing Water Solubility).

Polyene antibiotics are very poorly soluble in water mostly due to a highly hydrophobic set(s) of conjugated double bonds. Increasing water solubility can be an advantage in certain cases, as it expands pharmacologicxal properties of the drug (Golenser, J., Frankenburg, S., Ehrenfreund, T. & Domb, A. J. 1999. Efficacious treatment of experimental leishmaniasis with amphotericin B-arabinogalactan water-soluble derivatives *Antimicrob Agents Chemother.*, v. 43: 2209-2214). To increase the water solubility of nystatin, we suggest to introduce additional hydroxyl functions (hydrophilic) to the nystatin molecule. The following modifications of the nystatin biosynthetic genes can lead to the desired effect (resulting compounds depicted on FIG. 12):

inactivation of dehydratase (DH) domain in module 3 of the nystatin PKS (14);

inactivation of DH domain in module 4 (15);

inactivation of DH domain in module 3 with simultaneous inactivation of ER domain in module 5 (16);

inactivation of DH domain in module 4 with simultaneous inactivation of ER domain in module 5 (17);

inactivation of DH domain in module 7 with simultaneous inactivation of ER domain in module 5 (18);

inactivation of DH domain in module 8 with simultaneous inactivation of ER domain in module 5 (19);

inactivation of DH domain in module 9 with simultaneous inactivation of ER domain in module 5 (20);

Extension, Truncation or Rebuilding of the Macrolactone Ring.

Novel derivatives of a polyene antibiotic nystatin can be obtained also through truncation of the nystatin PKS, leading to derivatives with a smaller macrolactone ring (as exemplified in example 2 for the ERD48 mutant). This can be achieved through deletion of one or more modules from the nystatin PKS. Such truncations can lead to production of polyketides with 36- to 6-membered lactone rings that potentially can be useful for further modifications and synthesis of novel pharmaceuticals. Extension of the nystatin macrolactone ring can be achieved through insertion of additional modules into the nystatin PKS. Such manipulations can also lead to production of the lead compounds for pharmaceutical applications.

The nystatin molecule can be completely rebuilt by the way of shuffling the PKS modules between the nystatin, or other PKSs so that completely new derivatives are produced. In this respect, the method disclosed in the patent WO 00/77181 can prove useful for making the recombinant DNA constructs serving this purpose.

Finally, the nystatin biosynthetic genes can prove useful for manipulation of other macrolide antibiotic biosynthetic pathways. Both PKS and modification enzymes can prove useful for such purposes. It seems likely that nystatin biosynthetic genes will be most useful for manipulation of other polyene antibiotic biosynthetic clusters, such as the one for pimaricin (Aparicio, J. F., Fouces, R., Mendes, M. V., Olivera, N., Martin, J. F. 2000. A complex multienzyme system encoded by five polyketide synthase genes is involved in the biosynthesis of the 26-membered polyene macrolide pimaricin in *Streptomyces natalensis*. Chem Biol, v. 7: 895-905). High degree of similarity on the protein level between the nystatin and pimaricin biosynthetic enzymes will most probably ensure that their hybrids are functional. On the other hand, different specificities of the heterologous modification enzymes might provide new tools for further structural changes on the molecules produced by genetically engineered strains.

EXAMPLE 6

Further Manipulations of the Regulatory Genes Leading to Increased Production of Nystatin Expression of nysRII Under Control of the PermE* Promoter in S. noursei ATCC 11455

To confirm the function of the nysRII gene predicted through analysis of its coding sequence (see Example 1), it was expressed in S. noursei ATCC 11455 under control of the PermE* promoter. The 2168 bp SalI-BclI fragment from the phage N58 (representing C-terminal part of nysRII) was cloned into the SalI-BamHI digested pGEM11Zf(−), resulting in construct pC1A1. The 811 bp N-terminal part of the nysRII gene was PCR-amplified from the phage N58 template with the oligonucleotide primers NSR2.1 (5'-GCCG-GCATGCGACGAA CAG GACGAGAGGT-3') (SEQ ID NO. 44.) and NSR2.3 (5'-GCCGTGGTCGACGAA GGC-3') (SEQ ID NO. 45). The conditions for PCR were as described above. The PCR fragment was digested with SphI and SalI, and ligated, together with the 2168 bp SalI-HindIII fragment from pC1A1 into SphI-HindIII digested pGEM3Zf(−) vector, giving the plasmid pC2A1. From the latter, the 3.0 kb SphI-HindIII fragment was isolated and ligated, together with the 0.3 kb EcoRI-SphI fragment containing the PermE* promoter either with EcoRI-HindIII digested pSOK804 vector (generating plasmid pC3A1), or with the 3.0 kb EcoRI-HindIII fragment from pSOK201 (generating plasmid pC3E1). Since the pSOK804-based vectors integrate site-specifically in the S. noursei chromosome, the pC3A1 plasmid could be regarded as a construct for nysRII expression in-trans. Plasmid pC3E1, on the other hand, is a suicide vector capable of integrating into the S. noursei genome only via homologous recombination through the cloned nysRII gene, thus providing expression of the latter in-cis. Introduction of plasmids pC3A1 and pC3E1 resulted in recombinant strains C3A1 and C3E1, respectively. In the former strain PermE* promoter is placed upstream of both nysRII and nysRIII genes (in-cis), while in the latter strain PermE* promoter is placed upstream of nysRII gene (in-trans). Nystatin production by the C3A1 and C3E1 strains was increased by 18% and 22%, respectively, compared to the wild-type S. noursei. Moreover, during fermentation experiments it was noticed that nystatin production by the C3E1 strain reached its maximum 24 h earlier than the wild-type strain. These data support the assumption that the nysRII gene encodes a positive regulator that may be used for enhancing the production of nystatin and its derivatives in S. noursei strains.

Expression of nysRIV Under Control of the PermE* Promoter in S. noursei ATCC 11455:

The start codon for nysRIV was reassigned, and is likely to be located 48 nt upstream of the originally proposed start nucleotide. Thus, nysRIV presumably encodes a 226 aa (long) rather than a 210 aa (short) protein as was previously suggested. The long and short versions of the nysRIV gene were PCR-amplified from the N58 recombinant phage DNA with oligonucleotide primers NR4P3 (5-CTCAGCATGC-CGAAAGGATGGCGG-3') (SEQ ID NO. 46) and NR4P5 (5'-AGGCAAGCTTCGGCGACACGGGCGT-3') (SEQ ID NO. 47), or NR4P4 (5'-CTCAGCATGCGTACGACCG-GCGGG-3') (SEQ ID NO. 48) and NR4P5, respectively. The conditions for PCR were as described above. The corresponding PCR products of 0.78 kb and 0.73 kb were digested with SphI and HindIII, and ligated, together with the 0.3 kb EcoRI-SphI fragment containing the PermE* promoter, with the EcoRI-HindIII digested pSOK804 vector, resulting in plasmids pNR4EL and pNR4ES, respectively. Both plasmids were introduced into S. noursei ATCC 11455 generating mutant strains NR4EL and NR4ES, respectively. Nystatin production by the strain NR4ES (expressing a 210 aa protein from the PermE* promoter) did not differ significantly from that of the wild-type S. noursei harboring only pSOK804, while the NR4EL recombinant (expressing a 226 aa protein from the PermE* promoter) produced nystatin at a level 36% above the wild-type level. These data suggest that the longer, 226 aa—long version, represents the actual NysRIV polypeptide. Moreover, these data support the assumption that nysRIV gene encodes a positive regulator that may be used for enhancing the production of nystatin and its derivatives in S. noursei strains.

SEQUENCE LISTING (49 sequences)

SEQ ID NO: 1 - DNA, 65140 bp, Streptomyces noursei
gatccggccggtgatgaactcctgctcctgtgcggtcagtccggtgtgcgtcggcagatagaagccgtcggcgctgagccgggccgcgttcaacgcgggccagtcggcggagaagtaaccgggctgacggctcatcggcttgaagaagacccgggtctcgatgccctcgccggcgaggtacgcgcacagctcgtcccgccgctcggcccgcaggtcgtacatccacagcacgtcgcgcggcggcatcagcgtgatgccggggatgtcgcgcagcgcctcgtcgtagcgcttctcgatgtcgcggcgcagggcgaggatggtgtccagctgctcggtctgcgcgagcgccaccgcggcctgcatgttggtcatccggaagttgtaggccagcttcttgtgcaggaagctgtggtccttggtgaacgccatcgcccgcagatgggccatctgctcggccaggtgcgggtcgtgggtcaggcagacgccgccctcgccggccgagatgatcttgttggcgaagagcgagaaacaggcgatgtcgccccgcggccgcaccccgtgcgcctcggcggagtcctccaccacccgcaggttgtactcgtacgccaggttcagcacggcgtccatgtcgcactgccggccgtagatgtgcaccggcatgatcactttggtgcgcggggtgatcttctcctcgatgcgggacacgtcgatgttcaggtcgtcgccgcagtccacgaacaccggcgtggcaccggtgtaggtcaccgcccaggcggacgcgatcatcgtgaactccgggacgatcacctcgtcaccggggccgacgcccagcgcgcgcagcgccagcgtcagcgccgtggtgccggaggagcaggcgacgccgaacggcacgtcgttgtacgcggcgaacgcctcctcgaaccgcctgacgtacggcccctgcgaagagatccagccgccgccgacggcctccgtcacatagtcgagctcgcggccctggagccacggcatggacaccggatacgtaaaggacatgggttttgagtcttcctcggtcagtcggttgccagggcgggaaggccgagcagcaggtccgccgccgcggcccggccgccggcgtcccgcagcagcccggcgaagtgctccgcgcgctcggtgaaggagggttggtcgagcacgcgggtgatcttgtccaggacgtcctcggtgtccacggtctccggccggtccagggtcaggctcaccccgaagtcctggccccggatcgcctggtcgtcgcagtccacccacaacggccggaccaccagcggctttccgaagtacaggccctcgtggtagccgttgccaccggcatgggtgaagaacgccttcacgttcggatgggccagcacgtccagctgcgacggcacccagccctcgatccgcaggttgtccggcagctcggcggccggcggcagcaactcctgttggccgcgcgggagtttccacaacacctggtggccccggccgtccagtcgccgggcgacctccaccagcgacgccacctgctcacgggtcagccgggtgatcgtgccgaagcccatgtacaccacggacttctgcgccgacagccagtccgacaggccgtcgtcgtccggtgcctggggcagcggcggcaccatcgtgcccaccagccgcagcttcggatgcatcgggaacgggtagtccaactcccttacggagtagcacaagacctgctccgcatggtcgatccgcgccatcatctgccgcgcctggggcgcgatgcccagctcggtgcggacccggttgtcctcctcgacgaccttgcggacgtccgacgtcaggaacatcccgagcgtccgcagccggaacagctggttctcgatccgctgagccagggacatcgcggccggcagccccgagtgcggcaccgggaaacccgacggggtgtaggacttggcgaacgggacgtgcgaggtgaggacgttgctcggcacgaacggcaccccgagcacgaacggaatgcccttggtgatcgccagctcgtacccgaactggcacatgctctcgatcaccatcagcgccggctcgacctcctcgacgatctcctccaggcggcggtacttcgccatccgcgactccggcgcgaacgaatgccgaatcaccgccgcgtgcgccttgaaccgcgaccgctgcgtcacctccgcatacgtcgcgtcgtcccatgtgaccgccgacatctgcgagacggtgtcgccgagcgacgcgaaccgaaccgggctgccgtccaccacggccgccacctcgtcgcgcgctttctcgtcggtggcgaaccacaggtccgccacgtcgcgccgggacaattccccggccagcacgagcagcggattgagcaggccgctttcggcataactgacgaacaggatcggccgccgattcgcgcccatggacaacacccctcggaatgtggcgggccgccgggcccgcgcgccacgcacccgcccggcccggtcgccgggtgagtgcattcgccgacgccgccacccgaggcgcgtgttgccggaaggaagggtcaccggccggcacccggaacgcgccgcgtggaaaacgggtcggttacttggtctcatgccacggaccggggaatcactagtcttcggcgcgcgacggccctttccgggccgtgtggccaatgcccgtccccggcgcccgtcattccttagggaaaagtacagcgtttgcgaacgtacgatccggcacgcagaggtgacctgaggccaacttttccgcaggggtgagcaaggcatgacgatcggagccgacgaggacccggtggtggtcgtcggaatggcctgccgttatccgggtggggtcgccggcccggaggacctgtgggaactggtccgcaccggccgcgacgcgaccaccgccttcccggacgaccgcggctgggacctggccgcactggccggcgacggacccggccgcagcgcgacccgcgagggcggattcctcaccggcgccgccgacttcgacgccgccttcttcggcatgtcgccccgcgaggccgtctccaccgacccgcaacagcgcctcgtcctggagaccgcctgggaagccctggagcgcgccggcatcgacccgcactccctgcgcggcagccgcaccggggtcttcgtcggcgccagcggccaggactacgccgccgtcacccacgcctcgcccgacgacctggacggacacgccctcaccggcctggcccccggcgtcgcctccggtcgcctggcgtacgtcctgggcctcgaaggccccgccgtcaccgtcgacaccacgtcctcctcgtcgctggtcgcgctgcactgggcggtccgcgccctgcgcgcgggggagtgcagcaccgccctggccggcggcgtcacggtgatgtccaccccggccgccttcgtcggccacacccgacagggcggcctcgcgcccgacggccgctgcaagccgttctccgacgacgccgacggcaccgcctgggcggagggcgtcggcatcgtcgtcctggagcacctgtccaccgcccgcgccgccggcaaccccgtcctcgccgtgctgcgcggctcggccgtcaaccaggacggcgcctccgacggcctcaccgcacccagcggtcccgcccaggaacgcgtcatccgcgccgccctcgccgacgcccgactcgcccccgccgacatcgatctcgtcgaggcgcacggcaccggcacccggctcggcgaccccgtcgaggcccgggcgctgctcgccgcctacggccaggaccgggacccggaccgaccgctgcgcctcggttccctgaagtccaccctcggccacgcacaggccgccgccggcatcggcggagtgatcaagaccgtcctgaccctgcggcacggcctgatgccgcgcatccggcacctggccacccccacccgccaagtcgactggtcccagggcgccgtggcccccctcaccgaccacacgccctggccaccggccgaccgaccgcgccgcgccggcgtctcctccttcggcatcagcggcaccaacgcccatgtgatcctcgaagaggcgccgcccgccgacgtccccgtcacccggcccggcaccctccgccccagcaccgtcccctggccggtctccgccgccacgcccgaagccctcgacgcccaactcgcccggctccgcgcccacctgcgcacccactcggacctggacccgctggacgtcggctactccctggccaccggccgcgccgcgctccgccaccgggcggtcctcctgccgcccgccgacggcaccgccgcggacgccgtcgagcacgcccgcggtgcggcccaccagcgccgcaccgccgtcctcttctccggccagggcagccagcgcccgggcatgggccgcgaactcgccgcccgcttcccggtgttcgccgacgcactggacgacgcgctgcgcgccctggaccggcacctggacggcccggtgcgcgaggtgatgtggggcaccgacgccgcgctcctggaccggaccggctggacccagcccgccctgttcgccgtcgaggtcgccctccaccgcctggtcgcgtccctcggcgtcacccccgacttcgtcggcggccactccgtcggcgagatcgccgccgcccacgtcgccggcgtcctgagcctggaggacgcctgccgcctggtggccgcccgcgccacgctgatgcaggcgctcccggccggcggcgcgatggccgcgctggaggccaccgaggacgaagtggccccgctgctcggcgcacacctcgcgctggccgccgtcaacggccccaccgcggtcgtcgtcgccggagccgaggacgccgtgcggcaactgaccgcccgcttcgccgaccgcggccggcgcaccagccggctggccgtctcgcacgccttccactcgccgctgatggagcccatgctcgacgccttccgggacgtcgtgagccgactgaccttccaccagccgtcgatcccgctggtctccaacctcaccggtgaactcgccggcagtgagatcaccagcgccgagtactgggtccggcacgtccgcgacaccgtccgcttcgccgacggcatcaccgcactggccaaggccggcgccgacgtcctgatcgaactcggccccggcggcgtgctgtccgcgatggcccgcgacaccctcggccccgacagcaccaccgacgtcgtccccgccctgagcaagggacggcccgaggagaccgccttcgccggcgccctcggccgcctgcacaccctcggcgtccccgtcgactggcccgccttctacgccggcaccggcgcccgccgcgtcgaactgcccacctacgccttccagcacgtgcgccactggcccaccccgccccgcccgaacggcgccgggcccggcgccctcggccaccccctgctcggctccgccgtcgaactcgccgacggcggcggcaccgtctgctccggcgccctctccctccgcacccacccctggctcgccgaccacaccgtcgccgggcgggtcgtgctgccggccaccgcgctgctggaactcgccgtgcgcgccggcgacgaggcgggctgcgacgtcctgcacgaactccacctcaccaccccgccggccctgcccgacgacgccgccctgcacgtccaggtgcacgtcggccccgccgacaccaccgggcgccgcgccgtcaccgtccacacccgccccgaccaccacccggccggcgactggacccgatgcgccaccggcaccctcggcagcaccccgccgtccgcagccgaagccgccacgggcggcaccccggccgcctggccgccggccgacgccgaacccctcgacctcgccgaccactacgaacggctcgccgaccgcggcttcgactacggcccgaccttccgcggcctgcgggccgcctggcgacgcggcgcggagatcttcgcggacgtggaatgcccgcccggcaccgccgacgacgcccccgaccacggactgcaccccgccctgctcgacgcggcccggcacgccgccatggcggtggacggcaccgtgcccgtcgcctggcacggcgtccggctgcacgccgtcggcgccaccgcgctgcgggtccgcatccgccccaccacgaccggcacgctgaccctcaccgcggtcgacgtgcacggcgcgccggtcgtcaccgtcgaggccctcaccgcccgcccgctgaccgacgaggaacgcgccgccccgcggacgccgcggcaggcccgcggcgagacgcccgccgacgcccgcccggcccggcccgcggcggcccgccccggcccggccggcgaacccctcccggacaccaccgggtcccaccccaccgccggccacctcgccgcgctgccgccggccgcccgggagcgccagctgctggacctggtgcgcacccaggccgccgccgtcctgggccaccccggccccgaggccgtcggcacccgcagcgtcttcaaggagctgggcttcgactcgttggccggcgtcgaactcgccgaccggctcaccgcccgcaccggactgcgcctgccggccaccctcgtcttcaacttccccacccccgaacgtgctgcccaccgcctcggggaactcctcgccgcaaccgcccccctcgaccccggggcgtacggagaggaactcaccaggttcgaggcgatcgtgacgaacctgccgcaggacggccccgaacgccgggccgtcgcggaccggttggacgccatcgtctccgcactccgccagaactcgcctgcagaggtgccctcctcggacgaggacatcgacacggtgtcggtcgacagactgctcgacatcatcgatgaagagttcgaaaccacatagagaaattgttgctttcgttcgcgacccgatgacgaggacggaccgatgcaggaaccccagcaaggccagccggaccagcaggagaaaatcgtcgactatctccggcgggtcacttcagatcttcgccgtgcccgccgccgcattggcgaactggaatccaaggacaacgagcccatcgccatcgtcggaatgggctgccgacttcccggcggcgtcaattcgccggaatccctgtgggacctggtgcgttccggcggcgacgccatttccggattccccgtcgaccgcggctgggacctggaaaccctcaccggaaacggcgacggcagcagcgccacccacgaaggcggattcctctacgacgccgcggaattcgacgccgccttcttcggcatctcgccgcgcgaggcgactgctatggacccccagcagcgcctcctcctcgaagtcgcctgggaggcgctggagcgcgccggcatcgcccccacagccctgcgcggcagccggtccggcgtgttcgtcggctcctaccactggggcgcgccctcggccgacgccgccaccgaactgcacggccacgccctgaccggcaccgccgccagcgtgctgtccggccgcctggcctacaccctcggcctcgaaggcccggccgtcaccgtcgacaccgcctgctcctcctccctcgtcgccctgcacctggcggcccagtccctgcgcgtcggcgaatcctcgctcgccgtgatcggcggcgtcacgatcctcaccgagccgtccgtcttcgtcgagttcagcgcccagggcggcctggcaccggacggccgctgcaaggcgttctccgacgccgccgacggcaccggttgggccgagggcgtcggtgtcctcgtcgccgagcggctctccgacgcgcagcgcaacggccatccggtcctcgccgtgctgcgcggctccgccgtcaaccaggacggcgcctccaacggcctgaccgcccccaacggcccctcccaggaacgggtcatccagcaggccctcgcccggaccggcctgacccccgccgacatcgacgccgtcgaggcgcacggcaccggcacccggctcggcgaccccatcgaggcccaggccctgctcgccacctacggccagggacacacccccgaccagccgctgtggctcggctccctgaagtccaacatcgggcacacccaggcggccgccggcgtcgccggtgtcatcaagatggtcatggcgctgcgccacggccacctgccgccgaccctgcacgccgacgcgccctcctcgcacgtggactggtccgccggatcggtacgcctgctgaccgagggccagcagtggccggagaccggacgtccgcgccgggccgcggtgtcctcgttcggcatcagcggcaccaacgcgcacgccctgctggaacaggcaccccaccccgcggacaccgcggacgccggcgacgacgccgcgcccaccgaaccggccggcgcgcccgccgcgctgccctggatcgtctccggacactccccgcaggcgctgcgcgaccaggccgccgccctggccgccagggtcgagaccgaccccgcgctccgcccccaggacatcgggcacaccctgcacaccgcccgcgccctgctcgaacgacgcgccgtcgtcgtcgcccccgaccgcgccgaactcctcgcggctacccacgagttggccgccggccggtccgcgaacgccgtcgtcgagggcctcgcggacgtcgagggtcggacggtgttcgtgttccccggtcagggttcgcagtgggtggggatgggggcccaactcctcgatgagtcggcggtgttcgcggagcggattgccgagtgtgcggcggcactcgccgagttcaccgactggtcgctggtcgatgtgctgcggggtgtggtgggtgcgccgtcgttggagcgggtcgatgtggtgcagccggcgtcgttcgcggtgatggtgtcgttggctgcgttgtggggttcccgtggtgtgttgccggatgcggtggtggggcattcgcagggtgagatcgctgccgcggtggtgtcgggtgcgctgtcgttgcgggacggggcgcgggtggtggcgctgcggagtcaggccattggtcgtgcgttggcggggcggggcgggatgatgtccgtcgcgctgtcggtggacgtgctcgaaccgcggttggtcgagttcgaggggcgggtgtcggtggccgccgtcaacggcccgcgctccgtcgtggtcgccggcgagcccgaggcgctggacgcgctgcacgcccggctgaccgccgacgacatccgggcccgccggatcgcggtggactacgcctcgcactcgcaccaggtcgaggacctgcacgaggaactgctggaggtgctggcggagctggcgccgcgcacgtcggaggtgccgttcttctcgaccgtgaccggcgactggctggacaccgcgcggatggacgccggctactggttccgcaacctgcgcggacgggtgcggttcgcggacgcggtggcggacctgctggcggcggagtaccgcgcgttcgtcgaggtcagctcgcacccggtgctgacgatggcggtcttggacctgatcgaggaggccggggtcacggccgtcgcgaccggcaccctgcgccgtgaccagggtggcgcgggccgcttcctgctgtcggccgccgaggtcttcgtgcgcggtgtggacgtggactgggcgggggcgttcgaggggaccggtgcggcccgggtcgacctgcccacctacgccttccagcgcgagcggtactggaacacccgcaccgccgccgaccgcaccccggccgacgccccgatggacgccgaattctgggccgccgtcgaacaggcggacgtctccgcgctgaccgccgcgctcggcaccgacgaggactccgtcgccgccatcctgcccggcctcacctcctggcgccgggcccgctcccagcgcaccaccctcgactcctggcgctaccgcgtcacctggacgcccctcgcccaggtgccccgcgccaccctgaccggcacctggctgctggtcaccaccgacggcatcgacgacaccgatgtggcaggggcgttggagagctacggcgccgaggtgcgccggctggtcctggacgaggagtgcaccgaccgcgccgtcctgcgggagcggctggccggcgcggaggacgtgaccggcatcgtctccgtcctcgccgccgccgaggacgacgccgcacgccaccccggcctcacccggggactcgcgctcaccgtctccctcgtccaggccctgggcgacgccgaggcgaccgcgccgctgtggttcctgacccgcggcgccttcgccaccggcccgtccgaccccgtcacccggcccctgcagagccagatcgcgggcgtcggctggaccaccgcgctggagcacccgcagcgctggggcggcaccgtggacctgcccgacaccctcgacgcccgggccgcccagcggctcgccgccgcgctgtccggcgccctcggcgccgaggaccagctcgccgtccgcgccgccggggtactggcccgccgcatcgtgcgtgccggacaccgcgccggacgaccggcacggacctgggcgccgcgcggcaccaccctgatcaccggcggctccggcaccctcgccccgcagctcgcccgctggctggccgaacgcggcgccgagcacgtggtgctggtcagccggcgcggtgccgacgcccccggagcgcccgaactcatcgcggaggcagccgagtcgggcaccgaggtgaccgtcgccgcctgcgacatcaccgaccgcgacgcggtcgccgcgctgctggccgacctcacggccgacggccgcaccctgcgcaccgtcatccacgccgccgccgccatcgagctgtccgcgctcgccgacaccaccgtggcggagttcgccgacgtcgtgcacgccaaggtcaccggcgcacggatcctcgacgaactgctcgacgacgcggaactggacgacttcgtcctgtactcctccaccgccggcatgtggggcagcggcgtgcacgccgcctacgtcgccggcaacgcctatctgtccgcgctcgccgagcagcgccgcgcccgcggactgcgcaccacctccatccactggggcaagtggcccgacgaccgggcacgcgagctggccgacccgcaccggatccgccgcagcggtctggagtacctcgaccccgagctggcgctcaccgcgctccagcacgtcctggacgacgacgagaccgtcatcggcctcatggacatcgactgggacacctaccacgacgtgttcaccgcgggccggcccgcgcacctcttcgaccagatccccgaggtgcggcgccgcctcgaccaggcatccgtcccggaccccgcgggcccggccgccgacggcctggccgcccgcctgcacggcctcgccgccgccgaacaggaccggctgctgctcaccctggtccgcaccgaggccgccgccgtcctcggccacgcctcggccgagtccttccccgagcgccgcgccttccgtgacctcggcttcgactcggtcaccgccgtggacctgcgcaaccggctcgtggccggcaccggactgcggctgccctcgacgatggtcttcgaccaccccaactgcgcggcgctcgccgcgttcctgaagacgacggcgctcggcgtccccggcgccgcaccgcagcagcacgccgctaccggcaccccggccgacgacgacccgatcgccgtgatcggcatgagctgccgctaccccggcggcgccgccacccccgaggaactgctgcggctcgccctcgacggcgccgacgtcatctcggagttccccgcggaccgcggctgggacgcccggggcctgtacgacccggaccccgaccgccccggccacacctactccgtccagggcggcttcctccacgaggccgccggcttcgatcccggcttcttcgggatctccccgcgcgaggcggtcgccatggacccgcagcagcggctcctgctggagacctcctgggaggcgttcgaacgcgccggtatcgaccccgcgtcactgcgcggcagcgccgccggcaccttcttcggcgccagctaccaggactactcctccaccgtgcagaacggcacgggggagtccgaggcgcacatggtgaccggcaccgcggccagtgtcctgtccggccgggtctcctacctgctcggcctggagggccccgcggtcaccgtggacaccgcctgctcctcctcactggtcgccctgcacctggcctgccagtccctgcgcgacggcgagagctccctcgcgctggccggcggtgcggccgtgatggccaccccgcacgcgttcgtcggcttcagccggcagcgtgccctggccaaggacggccgctgcaagccgttctccgacaccgccgacggcatgacgctcgccgagggcgtcggcgtcgtcctgctggagcgcctgtcccacgcccgcgccaacgggcaccgggtactggccgtgatccgcggttccgccgtcaaccaggacggcgcctccaacggcctgaccgcgcccaacggcccgtcccagcagcgcgtcatccgccaggcgctcgccaacgccggcctgaccggcgccgacgtcgacgcggtcgaggcgcacggcaccggcaccaagctgggcgaccccatcgaggcccaggccctgctcgccacctacggccaggaccgcgacgccgaacggccgctgctgctgggctcggtgaagtccaacatcggccacacccaggccgcggccggcgtcgccggcgtcatcaagatggtgctggccatggacgccggcgaactgcccggcaccctgcacctcgacgcgccctccagccacgtcgactggaccgccggcgccgtggaactgctgcgcgggcgcaccccgtggcccgagagcgggcgcccccgccgggccggtgtctcctcgttcggcatcagcggcaccaacgcccacctgatcctcgaacaggccccggccaccgagccgccagccgaccccgaccgcctccgggacaccgccaccgacaccgtcgtcccctggccgctcgccgccaagtccccggccgccctgcgcgcccaggccgcccggctcctcgccaccgtcgagcacgaccccgacctcccgcccgcccccgtgggccacgccctggccaccacccgcgccgccctcgaacaccgcgccgtcgtcgtcggcgagcgccgcgaggacttcctgcgcggcctggccgccctgtccaccggcgcctcgacggccggcctggtcagcggcatcgccggccccgaccccgagggagcggtcttcgtcttccccggccagggatcccagtggtggggaatgggccgcgaactcctcgccacgtccgaggtgttccgcaccgcgatcgatgactgcgcgacggccctcgccccgtacgtcgactggtcgctgcacgacgtcctggccggcgagggcgaccccgccctgctggagcgggtggacgtggtccagcccgcgctgttcgccatgatggtcgggctgtccgcgctctggcgctcccacggcgtcgtcccggcggccgtggtcggccactcgcagggcgagatcgccgcggcctgcgtcgccggagccctcagcctggccgacgccgcccgcgtggtggcgctgcgcagccaggcactgccgcaactgtccggacgcggcggcatgatgtcggtctccgcccccgtagagcgggtcaccgcactcctcgccccgtggcaggaggcgctgtccgtcgccgcggtcaacggcccctcgtccgtggtcgtctccggcgacaccgacgcgctcgacgccctgcacaccgcctgccaggaacagggcgtgcgggcccgcaaggtgtccgtggactacgcctcgcacgggcggcacgtcgaggccgtccgcgacgaactcgcccgcgtcctcgcgccggtcgacccgcgcgcccccgaggtgccgttctactcgacggtcaccggcgaccgcgtggacgacgccgccttcgacggcgcctactggtacaccaacctccgccagaccgtccgcatggaggaggccacccgcgccctcctcgccgccggacaccgcgtcttcatcgaggtcagcccgcacccggtgctcgccgccccgatccaggagacgcaggaggccgtagcggaggccaccggcgggtccgcggtggtcctcggctcgctccgccgcgacgagggcggcccgcggcgcttcctgacgtcgctcgccgaggcccacacccacggcgccccggtcgactggaccaccaccttcgcccggtccgcctaccagccggtggacctgccgacctaccccttccaacgacaggacttctggcccgaggcccggcccgccaccccggccgccggcgccgacgcgtccgacgccgcgttctggcaactggtcgagaaccaggacctcgccgcgctcgccgacgcgctcggcgtccccgccgacgacgagcacaccgcgctcggcaccgtgctgccggccctgtccgcctggcgcgccaaggcccaggcccgcacccggatcgacgaactccgctaccacgtccagtggacccgggtcgccgagcccgcggcggcccccaccaccggccggctgctggtcgccgtcccgccggaccacgccgacgccccctgggtcgccgcggcgctcgacgccctgggcaccgacaccgtccgcttcgaggccaagggcaccgaccgcgcgggatgggccgcacagatcgcccaactcgtcgaggacggcgaggagttcaccggcgtggtgtcgctgctggccgccgccgaggatctccacccggacttcggctcggtaccgctggggctggggcagaccctcgtcctcgtccaggccctcggcgacgccggcctgaccgcgcccctgtggtgcctgacccgcggcgccgtcgccaccggccgcgacgacgccctcgacagcccgacccagggcgccctgtggggcctcggccgggtcgtggccctggaacaccccgaccgctggggcggcctgatcgacctgcccgccaccctcgacgcccgcgccgcggcccgcctcaccggcctgctcgccgaccccgccggtgaggaccaactcgccgtccgcgccaccggcgtgctcgcccgccgcatggtgcacgccgcgccgtccgcgccccgcaccgggcgccgctggcggggccgcggcacctgcctgatcaccggcggcaccggcggcatcggcggccgggtcgcccgctggatggccgagcacggcgccgcccacctggtcctgaccagccggcgcggcccggacgcacccggcgccgccgcactccgggccgaactggaggccctgggcgcccgcgtcaccctcgccgcctgcgacgtcgccgaccgcgacgccctggccgccctgctggccgacctccccgccgaccagccgctcacctccgtcttccactccgccggcgtggccgacggggacgcccgggcagccgacctgaccctagatcagctcgacgcgctgctgcgcgccaaactgaccgccgcccaccacctgcacgagctgaccgcccccctcgacctcgacgcgttcgtgctcttctcctccggcgccgcggtctggggcagcggcggccagcccggctacgccgccgccaacgcctacctcgacgccctcgccgcccaccgcaggtccctcgacctgcccggcgcgtccgtcgcctggggcacctggggcgaggtcggcatggccaccgtccccgaggtccacgagcgactgcaccgccaaggggtccgcgccatggaaccggaccacgcgatcggcgcgctccagcagatgctggaggacgacgacaccaccctcgccgtgaccctcatggactgggaggcgttcgcaccgagcttcaccgcgacccgacccagcgccctgttcagcacggtgcccgaagccgtccgcgcggtgaccggcgacccgggcaccacggccggcgacgacgtggactccgcgaccccgccgctccgccgccacctggaggagctgtccgccgccgagcgcggccgggccctggtcgaggcggtccgcgccgaggcgtccgcgaccctcggccacgacacccccgacgccatccccgccggccgtgccttccgcgacgtcggcttcgactcggtcaccgccgtcgaactgcgcaaccggctgcgcaccgccctcggcctgccgctgccggccgcgctcgtcttcgaccaccccacccccacggccctcgccggccacctcggcgcgctgctcttcggcaccgcccccgaggacgccggcaccggccgccccgacgaccccgacgcccgcatccgcgaggcgctcgccaccgtccccatcggacggctgcgcaaggcgggcctcctcgacatggtgctgaaactcgccgacggagacgcgaccgacgcccccgcccccgaggccgacgccccctcggaatccctcgacgacatggacgccgaagccctgctgcggctggccaccgagaactcggcgaactgaaagagagctggagcccaccatgagcacgaaccccgacaagtacgtcgaggcactccggtcgtccctgaaggagatcgagcggctgcgccggcagaacgaacagctggtggcggcggcggtcgagcccgtcgcggtcgtcggcatcggctgccgcttccccggcggcgtcacctcccccgaggacctgtgggagctggtcgccgaggggcgcgacgtcatcgggccgttcccgcaggaccgcggctgggacctggagaagttggccggcggcggcgagggcggcagcctcgcgcaggtcggcggcttcgtcgaggacgccgccggcttcgaccccggcttcttcggcatctccccgcgcgaagcggtcgccatggacccgcagcagcgcatcctgctggagatcacctgggaagccctggaacgcgccggcatcgacccgtccaccctgcgcggtacccccaccggcgtcttcgtcggcaccaccggccaggactacggcgaggtcatcaaggcgtccgccgaggacgtcgaggtctactcgaccaccggccacgccgccagcgtcatctccggccggctctcctacaccctcggcgccgagggcccggccgtcaccgtcgacaccggctgctcctcgtccctggtcgccctgcactgggccgtccaggcgctgcgcggcggcgagtgctccatggccctggccggcggcgcgtccatcatggccaccccgggcccgttcgtcgccttcaccgcgcagagcggcctggccgccgacggccgctgcaagcccttctccgaccgggccgacggcaccggctggggcgagggcgccggcatgctggtcctgatgcggctctccgacgcccagcgcgagggccgcccggtcctcgccgtgctgcgcggctccgccatcaaccaggacggcgcctccaacggcctgaccgctcccaacggcccctcccagcagcgcgtcatccgcgccgcgctggacagcgcccacctcaccgccgccgacatcgacgccgtcgaggcccacggcaccggcaccaccctcggcgacccgatcgaggcccaggcgctcctggcgacctacggacaggaccggccgcggcccctgtggctcggctcggtgaagtccaacatcggccacacccaggccgcctccggtgccgccggcgtgatcaaaatgatcatggcgttgcagcgcggcgtgctgccgcgcagcctgcacgccaccgaacccaccacggacgtcgactggaccgccggctccgtcgacctcctcgacgagacggtcgcctggcccgagaccggacgcgcccgccgcgccggcgtctcctccttcggcatcagcggcaccaacgcccacgtcatcctcgaacaggcccccaccgcccccgaagagcccaccaccgaacccaccgtccgccccgccgtcgtcccgtgggcgctctccgcccgcaccgccgccgccctcgacgcccagcgcgcccgcctcaccggccacctcgccgacacccccgacgccgaccccctcgacgtcggctacgcgctcgccgacggacgcgccaccttcgaacaccgcgccgtcctgctccccgacggcaccgaactcgcccacggaaccgccggcgaaggcccctgcgccgtcctcttctccggccagggctcccagcgcccgggcatgggacgcgaactccacgcccgcttcccggtgttcgccgcggccttcgacgagatcacagcgctcctcgacacccacctcgaccgcccgctgcgcgaggtcgtctggggcaccgacgccgacctgctgaacgacaccggctgggcccaacccgccctgttcgccgtcgaggtcgccctctaccgcctggtcgcgtccctcggcgtcacccccgacttcgtcggcggccactccatcggcgagctcgccgccgcgcacgtcgccggggtcctctccctcgaagacgcctgcaccctcgtcgccgcccgcgcccgcctcatgcaggccctgccgcgcggcggcgcgatgctcgcgatccgcgccaccgaggacgaggtcaccccccacctcaccgacgacgtctcgatcgccgccgtcaacgggcccacctccgtcgtcgtcgccggcaccgaggaagccgtcgccgcgatcggggcgcgcttcaccgcccaggaccgcaagaccacccggctgcgggtcagccacgccttccactcgccgctcatggacccgatgctggcggaattccgcgccgtcgccgcgggcctgacctaccacgagccgcgcatcccggtcctctccaacctcaccggcaccgtcgccgccgtcgccgacctgtgctccgccgactactgggtccgccacgtccgcgaggcggtccgcttcgccgacggcgtcaccgccctcaccgaccgcggcgtgaccacgctcgtcgaactcggcccggacggcgtgctgtccgccatggcccaggaatccctgccggacggcgccgccgccgtgccgctgctgcgcaaggaccgccccgaggagctctccgccgtcaccggcctggcccgcgcccacgtccgcggcgtcacggtccgctgggccggcctcttcgacggcaccggcgcgcgccgcgccgacctgcccacctaccccttccagcaccagcggttctggccgaccgcggcccgcgccgcccaggacgtcaccgccgcgggactgggcgccgccgaccacccgctgctcggcgccaccgtcgaactcgccgacggggccggctacttgttcaccagccggctctccgtccggacccacccctggctcgccgaccacggggtccagggccgggccctgctgcccggcaccgccttcgtcgaactggccgtccgcgccggcgacgaggccggctgcgaccgcgtcgaggaactgaccctggccgcccccctggtgctgcccgagcgcggcggcgtccaactccaggtccgcgtcggcgcccccgacgccgccggccgccgcaccctcggcatcttctcccgcgtcgaggacggcttcgacctgccctggtcgcaacacgccaccggcgtcctgaccgccggcgccggcgcccccgaccccaccttcgacgccaccgtctggccccccagcggcgccgaacccgtcgacctcaccggcgcgtacgagcgcctggccgcactcggcttccagtacggccccgccttccagggcctgcgcgccgcctggcgccgcgacaccgaggtctacgccgaagtggccctgcccgacggcgcggacaccgaccccgccgccttcggactgcacccggccctgctggacgccgcacaacacgccgccgcctacgccgacctcggcgccatcagccgcggcggcctgccgttcgcctgggaaggcgtctcgctcgccgccgccggcgccaccaccgtccgcgcccggatcgccccggccggcgaggacaccgtcaccatcgccgtctacgacgccgccggcggcaccgtgctgtccgtcgactccctggtctcccgcgaggtccccgccgacgcacccggcgccgccggcaccgtccaccgcgactccctcttccacgtcgagtggaccccgctccagggccgcccgggccccgcaccggccaccgtcgccgtcctcggccccgacccggacgccctcgccgacaccctccgcgccaccggcatccggaccaccgccccccgcgacctggccgccctcgccgacgccgaagggcccgtccccgacctggtcgtcaccaccctcaccaccaccccgggcgcccccgtccccgacgccgcgcacgccaccaccgccgccgtcctcgccctcgcccaacagtggctcgccgacgaccgcttcgccgacgcccgcctggtcctcgtcacccgcggcgccaccgacggcaccgaccccgccgccgcggccgccggcggcctgatccgcaccgcccgcaccgagaaccccggccgtttcgccctcctcgacctcgcccccgacaccggccggcccgaccccgagaccctggccaccgccctggccgccagccacgacgagcccgacctcgccgtccgcggcaccgacgtgcacgccgcccgcctggcccgtgtcccgctcgccaccgaacccaccacctggaacccggacggcaccgtcctgatcaccggcggcaccggcggcctgggcgcggtcctcgcccgccacctggtcgccacccacggcgtccgccacctgctgctcgccagccgccgcggcccggccgccgacggcgccgacgacctgacggccgaactcaccgggctcggcgccaccgtccacatcgccgcctgcgacgtcgccgacccggccgccctcgccgacctgctcggcaccgtcccggccgggcacccgctcaccgtcgtcgtccacaccgccggcgtcgtcgacgacggcgtcctcggctccctcaccccgcagcgcctggacaccgtcctgcggcccaaggccgacgccgcctggcacctgcacgaggcgacccgccacctcgacctggacgccttcgtcctcttctcgtccgtcgccgccaccctcggcagccccggacaggccaactacgccgccggcaacgccttcctggacgccctcgccgcccggcgcgccgccaccggcctgcccgccacctccctcgcctggggcccgtggacccagagcgtcggcatgacaagcagcctgtccgacctcgacgtcgagcgcatcgcccgctccggcatgcccccgctgaccctggaacagggcaccgccctcttcgacgcggccctggccgccgggcccgccgccctcgccccggtccgcctcgacctgcccgtcctgcgcacccagggcgacatcgccccgctgctgcgcggcctgatccgcacccccgtgcggcgcaccgccgcccaggtctcgcagaccgccgacggcctcgcccagcggctcgccggcctcgacgccgccgcccgccgggaagccctcctggaactcgtccgcacccagatcgcccaggtcctcggccacgcggacgccaccgaggtggagaccggccgccagttccaggacctcggcttcgactccctcaccgccgtcgaactccgcaacgccctgaacaccgccaccggcctgcggctgcccgccaccatggtgttcgactacccgacaccacacgccctcgccgaccacctgcgcgacgaactcctgggcaccgaggccgagtcgaccaccgccgtccccgtgccgacccgtaccgccggcaccgacgacccgatcgtcatcgtcggcatggcctgccgctaccccggcggcatcgcctcacccgaggacctctggcgcctggtcagccagggcgccgacgccactggcccgttccccaccaaccgcggctgggacctggacaacctctacgaccccgaccccgaccgcccgggccgcacccacgtccgcgccggcggcttcctgcacgacgccggctccttcgacgccgacttcttcgggatgagcccgcgcgaggcgatggccaccgactcccagcagcgcctgctgctcgaactctcctgggaagccgtcgaacgcgccggcatcgaccccgcctcactgcgcgactccggcaccggcgtcttcgccggcgtcatgtacaacgactacggcaccaccctgaccggcgacgagtacgaggcgttccgcggcaacggcagcgccccgagcgtcgcctccggccgcgtctcctacaccctcggcctggaaggcccggccgtcacggtggacaccgcctgctcttcctctctggtcgccctgcactgggcggcgcaggcgttgcgggcgggggagtgctcgttggcgttggccggtggtgtgacggtgatgtcgacgccgagcacgttcgtggagttctcgcggcagcggggtctggcgcctgatggtcgttcgaaggcgttcgccgaggccgcggacggcgtggcctggtccgagggcgtcggcatgctggtcctggagcggcagtcggacgcggtgcgcaacggtcacgagatcctggccgtggtgcgcggctcggcggtcaaccaggacggtgcgtccaacggtctgaccgcgcccaacggcccgtcccagcagcgggtgatccgtcaggcgttggccagtggcggcctgtccacggccgacgtggacgccgttgaggcgcacggcacgggtacgacgctcggtgacccgatcgaggcccaggcgctcctggccacctacggtcgcgaccgcgaccccgagaacccgctgctgctcggctcgatcaagtccaacatcggtcacacccaggcagcggccggtgtcgccggtgtcatcaagatggtcatggcgatgcggcacggcgtgctgccgcagaccctgcatgtcgacgcgccgtcctcgcacgtcgattggagcgtcggcgccgtcgaactgctcaccgagcagaccgcctggccggagaccggccgggcccgtcgcgccggtgtctcctccttcggcatcagcggcaccaacgcccacgtcgtcatcgagcagtccccgaccgccgtccccgccacgcccgcgtccgccgaccggtccgtcgaggaaccgccggccgtcccctgggccctgtccggcaagacccccgacgccctccgcgaccaggccgcccgcctcctcgcccacgtcgaggcccaccccgcactgcgccccgtcgacatcagctactccctgatcgccacccgcaccgccttcgaccaccgcgccgtcgtcctcggcaccgaccgcgccgaggccctgcgcgccctcaccgccctcgccgccggcgagaccgacccggccgccctcaccggcaccgtccgcaccggccgcaccgccttcctcttctccggccagggctcccaacggctcggcatgggccgcgtcctctacgagcggttccccgccttcgccgaagccctcgacaccgtcctcaccgccctcgacgcggaactcggccaccccctccgcgacatcatctggggcgaggacgctcaactcgtcgaccggaccggctacacccaacccgccctgttcgccatcgaggtggcactcttccgcctcctggaagcctggggcatcacaccggacttcgtggccggccactccatcggcgagatcgccgccgcacacgtcgccggcgtgctctccctcggcgacgcctgccgcctcgtcgtggcccgcgccgtgctgatgcagtcgctgcccgaaggcggcgcgatgatcgccgtccaggccaccgaggacgaggtcctgcccctcctcaccgacgacgtctcgatcgccgccgtcaacagcccgacctccgtcgtcgtctccggctacgagaacgccaccctcgccgtcgcccggcacttcgccgaccagggccgccgcaccacgcggctgcgcgtcagccacgccttccactcgccgctgatggcgccgatgctcgacgacttccgcgccgtcgtcgagagcctcaccttcaccgcccccacgacccccgtcgtctccaacctgaccggcgaactggccccggccgaggcgctctgctcggccgactactgggtccggcacgtccgcgaggcggtccgcttcgccgacggcatccgcaccctcgccgaccgcggcgtcaccaccttcgtcgaactcggccccgacagcgtgctgtccgccatggcccaggagtccgcccccgaaggcgccggcaccatcccgctcctgcgccgcgaccggcccgaggaacaggccgtcctggccgccctctgccacctccaggtgctcggcgtcgaggccgactggtccgccaccttccgcggcctcgaccccgtccgcgtcgacctgccgacctacgccttccagcaccgctggttctggcccgccgcccgacccgcccgccccgacgacgtccgcgccgccggcctgggcgccgccgaacaccccctcctcggcgccgccgtgcaactccccgacgacgacggcgcactcttcaccggccgcctctccctgcgcacccacccgtggctggccgaccacaccgtcctgggcaccgtcctgctcccgggcaccgcactggtggaactcgccgtccgcgcgggcgacgagaccggcagcggccacctcgaagaactcaccctcgccgcgcccctgaccctccccgaggacggcgccaccctcctccaggtccgcgtcggatccgccgacgacaccggccgccgcaccgtcaccgtccacgcccgccccgacgacaccgccgaccgcacctggacgctgcacgccaccggtgtgctcgccaccacgccaccggccgccgcggcgttcgacaccacggtctggccgcccgccgacgccgaacccctcaccaccgacgactgctacgcacacttcaccacccaccgcttcgcctacggccccgccttccagggcctgcgggccgcctggcgcgccggcgacgtgctgtacgccgaggtcgccctgccggagtccgccaccgacgaagcggccgccttcggcctgcacccggcgctcctggacgccggcctgcacgccgcgctcctcgccgacgaccgcgacaccggactcccgttctcctgggaaggcgtcactctgcacgcctccggcgccaccgcgctacgcgtccggctcgccccgaacggccccaacggcctgtccgtcaccgccgccgacccggccggcaaccccgtcgccaccgtcacccgcctgctcgcccgccccctggacgccgagcagttgaccatccacagcgccctgacccgcgacgcgctcttccacctggactggaccccggtcccgcttcccgacaccgccaactccgcgccgccggccctcctcggcccggacaccgccgtgctcgccgacgccctcggcgacccggccgtcgcacgccacgcaaccctcgacgacctcctggccggggacaccaccccgcccgccacggtcctcgtccccctcggcgccccactcgacggcgacaccgcgcagcacgcgcacgccctcacccgcagcgcgctgaccctcgtccagcagtggctcgccaccgaccgcctcgccgactcccgcctggtcttcgtcacccacggagccgtcgccaccgacgacgcgccccccaccgacctggccgccgccgcggtctggggcctgatccgctccgcgcagaccgagaaccccggcaccttcaccctcctcgacctcgacaccgagcccgactcgaccaccgcgctcagccgcgccctgaccctcgacgaaccacagctcctcctccgcgccggccgcgcccgcgccgcccgcctcacccgcacccccgcccccaccaccaccacccacacgccgtggtccgcggacggaacggtgttggtgacgggtggtacgggtggtctgggtgggttggtggcccggcatctggtgcggtcgtgtggggtgcggcatttgttgttgaccagtcgttctggtgtgggtgctgcgggtgcggccgggttggtcgcggagttggagtcgttgggcgcgcgggttgtggttgcggcgtgtgatgtgggtgatggctcggctgttgcggagttggttgccggtgtgtcggagtcgtatccgttgtctgcggtggtgcatgcggctggtgtgttggatgacggtgtggtgggttcgttgacgccggagcggttggctgcggtgttgcgtccgaaggtggatggtgcgtggaacctgcatgaggcgacgcgtggtctggatctggacgcgtttgttgtcttctcgtctgttgcgggtgtgttcgggggtgcgggtcaggccaactatgcggcgggtaatgcgtttttggacgcgttgatggttcatcgggtggctggtgggttgcctggtgtgtcgttggcgtggggtgcttgggatcagggtgtggggatgacggcggggctgacggagcgggatgtccgtcgtgctgctgagtcgggtatgccgttgttgacggttgatcagggtgtggcgttgttcgatgcggcgttggcgacggggagtgccgcgttggtgccggtccgtctggacctggccgcactgcgcacccggggcgacatcgcaccgctcctccgcggcctcgtccgcgcaccgctgcgccgcaccgcggccaccggcctcgccaccggcgcggacaccggcctcgtccaacggctcggccgactcgaccacgcccaacgccacgaggcactgctcgacatggtccgcagcagcgccgcgctcgtcctcggccacgccgacggcaacgccatcgacgccgaacgcgccttccgcgacctcggcttcgactcgctcaccgcggtcgaactccgcaaccgtctgcgcaccgccaccggcctgcacctgtcggccaccatggtcttcgaccaccccaccctgtccgccctcgcggagcacctgcgggacgagttgttcggcgcggtcgagagcgaggtgcgggtgccggtccaggcactgccgccgaccgccgacgatcccatcgtggtggtgggcatggcctgccgtttccccggtggtgtgacctcgcccgaggacctgtggcgcctggtcgacgacggcaccgacgccatcaccaccttcccgaccaaccgcggctgggacctggacaacctctacgacccggaccccgagcacttcggcacgtcgtacacccgctccggtggcttcctgcacgaggcgggggagttcgacccggcgttcttcggaatgagcccgcgtgaggcgctggcaaccgactcccaacagcgtctcctgctggaatcctcctgggaggcgatcgagcgggccggcatcgacccgctgaccctgcgcggcagcgccaccggcgtcttcgccggcgtgatgtacagcgactacgggagcatcctcggcggcaaggagttcgagggcttccaaggccagggaagtgcgggcagcgtggcctcgggccgcgtctcctacgccctcggcttcgagggcccggccgtcacggtggacacggcttgctcttcctctctggtcgccctgcactgggcggcgcaggcgttgcgggcgggggagtgctcgttggcgttggccggtggtgtgacggtgatgtcgacgccgagcacgttcgtggagttctcgcggcagcggggtctggcgcctgatggtcgttccaaggcgttcgccgaggccgcggacggcgtcggctggtccgagggcgtcggcatcctcgtcctggagcgccagtcggacgcggtgcgcaacggccacgagatcctcgccgtgatccgcggctcggcggtcaaccaggacggtgcgtccaacggcctgaccgcgcccaacggcccgtcccagcagcgcgtcatccgtcaggcgttggccagtggcggcctgtccacggccgacgtggacgccgtcgaggcgcacggcacgggtacgacgctcggtgacccgatcgaggcccaggcgctcctggccacctacggccgtgaccgcgaccccgagaaccccctgtggctgggctccctgaagtccaacatcgggcacacccaggcagcggccggtgtcgccggtgtcatcaagatggtcatggcgatgcggcacggcgtgctgccgcagaccctgcatgtcgacgcgccgtcctcgcacgtcgattggagcgtcggcgccgtcgaactgctcaccgagcagaccgcctggccggagaccggccgggtccgtcgcgccggtgtctcctccttcggcatcagcggcaccaacgcccacgtcatcgtggaacagccggcgctcgtcgaaagcccggccgcggagccgagcggacgcgaacccggcgtcgttccgctgccgctgtccggaaagtcccccgaggccctgcgcgaccaggccgcacgcctgctggccgggttggcggagcggcccgcgctgcgcccgctcgacctcggctactcgctggcgacgacccgttcggcgttcgaccaccgggcggtggtgctcgccaccgaccgcgccgatgcggtccgcgcgctgacggcgctcgccgccgccgacgcggatctctccgccgtcgtcggcgacacccgcacgggtcgtcacgcggtgctgttctcgggtcagggctcgcaacgcctgggcatggggcgtgagttgtacgagcgtttcccggtcttcgccgaggctctcgatgtcgcgatcgaccacctggacgccgccttgcccgcccaggccagtctgcgtgaggtgatgtggggcgacgatgtcgagctgctggacgagacgggttggacgcagccggctctgttcgccgtcgaggtggccctgttccggctggtggagagttggggtgtccgtccggacttcgtggccggtcattccatcggtgagatcgcggcggcgcatgtcgtcggggtgttctcgctggaggacgcctgccgtctggtggccgcccgtgcgacgctgatgcaggcgctgccgaccggcggcgcgatgatcgcgatccaggccgccgaggacgaagtcacccagcacctgactgacgacgtctcgatcgccgccgtcaacggcccgacctccgtggtcgtctccggggccgagagcgctgcccgcacggtggccgaccggctcgcggagaacggccgcaagacgacccggctgcgggtctcgcatgcgttccactcgccgttgatggatccgatgctggcggagttccgtgcggtggccgagggcctgtcctacgccaccccgaccctccccgtcgtctcgaacctgacgggccggctggccacggccgatgacctctgctcggccgagtactgggcgcgccacgtccgcgaggcggtccgcttcgccgacggcgtcagcaccctggagaacgagggcgtcaccacgttcctggaactgggaccggacggcgtgctgtccgccatggcccagcagtcgctcaccggcgacgccgccaccgtcccggccctccgcaaggaccgcgacgaggagacgtccgcgctcaccgccctcgcccacctccacacggcaggtctccgcgtcgactgggcggcgttcttcgccggcagcggcgccacccgcgtggacctgccgacctacgccttccagcacgccacctactggcccaccggcaccctgcccaccgcgcacgccgcggccgtcggcctcaccgccgccgagcacccgctgctgaacggttcggtcgaactcgccgaaggcgaaggggtgttgttcaccggacggctgtcactgcagtcacatccgtggctggccgaccacgccgtcatgggacaggtcctgctgcccggcaccgcactgctggaactggcgttccgggccggcgacgaggccggttgcgaccgcgtcgaggaactgacgctcgccgcaccgctcgtcctgcccgagcgcggtgcggtacagacccaggtccgggtcggcgtcgccgacgacaccggccgccgtaccgtcaccgtccactcccggcccgagcacgcgaccgacgtgtcgtggacccagcacgcgaccggcaccctgaccatgggctccgccccggccgacaccggtttcgacgccactgcctggccgcccgccgacgccgaacccctcgccaccgacgactgctacgcgcgcttcacgacgctcggcttcgcctacgggccggtcttccagggcctgcgggccgcctggcgcgccggtgacgtgctgtacgccgaggtggccctggcggagtccaccggcgacgaggcgaccgccttcggtctgcaccccgcactgctcgacgccgccctgcacgcctccctcgtcgcccacgagggcgaggagagcaacggcggactgccgttctcctgggagggcgcgaccctctacgcgaccggcgccaccgcgctgcgcgtccggctgaccccgacgggcaccgacggccgttcggtggccatcgccgtggccgacaccgccggtcgtccggtcgccgccatcgacaacctcgtctcgcgccgggtctccggcgaccagttgaccggcgccgcgggactggcccgcgacgccctgttcaccctggactggaaccccgtaccggagaacctcgtaccggagaaccctgtaccggagaacaccggcgggggccacgcccaggaccaggacggccggcccgccgcggccaccgtcgcgctggtcggcgcggacggcaccgcgatcgccgccgacctgaccgccgccggcatccacaccaccctccaccccgacctcaccaccctcgccacgaccgacgccgacgttccgaagacggtcctcatccccctcaccggaaccggaaccggaaccggcaccgggactgagtcgacggacggaatcgggacgggggccgccgagtcggacgcgtccgccccctccccggccgaggtcgcccacaccctgtccaccgccgcactcgccctcgtccaggagtggaccgcacaggagcgcttcgccggctcccgcctggcgttcgtcacgaccggggcgacggccgccggcggtaccgacgtcatggacgtggccgccgccgcggtctggggcctggtccgatccgcccagtccgaagccccggacaccttcgtcctgatcgaccgtgaccccggcccggccggcacgcacgaccgcacagccgccgccgaacggggccaactgctcctacgggcactgcacaccgacgaaccgcagctcgccctgcgtgacggcggcgtgctcgccgcccgcctggcccgcttcgacaccgcggccgcgctcaccccgccggccgaccgggcctggcggctcgacagcacggccaagggcagcctcaacggcctcgccctgaccccgtatccggcggcactggcgccgctcaccggccacgaggtgcgggtcgaggtgcgtgccgcgggcctgaacttccgtgacgtgctcaacgcgttggggatgtatccgggtgatgatgtcggatcgttcggttcggaggcggccggtgtggtcgtcgaggtcggaccggaggtgaccggcctggcccccggcgaccaggtcatgggcatgatcaccggcagcttcggctcgctcgccgtggacgacgcgcggcgcctcgcccgcctgcccgaggactggtcctgggagacgggtgcgtcggtgccgttggtgttcctcaccgcgtactacgccctgaaggagttgggtggtctgcgggcgggggagaaggtgctggtgcatgccggtgccggtggtgtcggtatggcggcgatccagatcgcccggcatgtcggtgccgaggtgttcgccacggccagtgagggcaagtgggacgtgttgcgctcgctcggcgtggccgacgaccacatcgcctcctcccgcaccctcgacttcgaggcggccttcgccgaagtcgccggcgaccgcggcctggacgtcgtcctcaactccctcgccggtgacttcgtcgacgcctcgatgcggttgctcggcgacggcggccggttcctggagatgggcaagaccgacatccgcgccgcggactccgttcccgacggcctctcctaccagtccttcgacctcgcctgggtggtgccggaaaccatcggcaccatgctggccgagctgatggacctcttccgcaccggcgcactgcggccactcccggtccgcacctgggacgtccggcacgccaaggacgcgttccgcttcatgagcatggccaagcacatcggcaagatcgtgctcaccctgccccgctcctggaagcccgagggaacggtgttggtgacgggtggtacgggtggtctgggtgggttggtggcccggcatctggtgcggtcgtgtggggtgcggcatttgttgttgaccagtcgttctggtgtgggtgctgcgggtgcggccgggttggtcgcggagttggagtcgttgggcgcgcgggttgtggttgcggcgtgtgatgtgggtgatggctcggctgttgcggagttggttgccggtgtgtcggagtcgtatccgttgtctgcggtggtgcatgcggctggtgtgttggatgacggtgtggtgggttcgttgacgccggagcggttggctgcggtgttgcgtccgaaggtggatggtgcgtggaacctgcatgaggcgacgcgtggtctggatctggacgcgtttgttgtcttctcgtctgttgcgggtgtgttcgggggtgcgggtcaggccaactatgcggcgggtaatgcgtttttggacgcgttgatggttcatcgggtggctggtgggttgcctggtgtgtcgttggcgtggggtgcttgggatcagggtgtggggatgacggcggggctgacggagcgggatgtccgtcgtgctgctgagtcgggtatgccgttgttgacggttgatcagggtgtggcgttgttcgatgcggcgttggcgacggggagtgccgcgttggtgccggtccgtctggacctggccgcactgcgcacccggggcgacatcgcaccgctcctccgcggcctggtcaaggcgcccatccgccgcgcagccgccaccacacccggcgacaccggactcgccgagcagctcacccggctccagcgcgccgagcgacgggacaccctcctcgcgctcgtccgcgaccaggccgcgatggtcctcggccacacctcgggcgacggcgtcgacccgtcccgcgccttccgcgacctcggcttcgactcgctcaccgcggtcgaactccgcaaccgcatcggcgcggccaccggcctgcggctaccggccacggccgtcttcgactaccccaccgccgatgccctcgccgcacacctgctcaccgaactgctcggccccgacgccgagtcggaccccgacgagcccggcgaccccaccgcgggaccgaccgacgaccccatcgtcatcatcggcatgagctgccgcttccccggcgacatcggctcgccggaggacctgtggcgcctgctcggcgacggcgccgacgtcgtcaccgacttcccgaccaaccgcggctgggacctggacaacctctacgaccccgaccccgcgcacgccggcacctcgtacgcccgcaccggcggtttcctgcacgacgccgccgacttcgacgccgacttcttcggcatgagcccccgcgaggccatggccacggactcccagcagcgcctgctgttggagtcctcgtgggaggcgatcgagcgggccggcatcgacccgctgaccctgcgcgacagccgcaccggcgtcttcgccggcgtcatgtacagcggctacggcacccgcctcgacggcgccgaattcgaaggcttccaggggcagggcagcgcactgagcgtggcctccggccgggtctcctacaccttcggcttcgaaggcccggccatgacggtcgacaccgcctgctcctcctcgctggtcgccctgcacctcgccgcacaggcactccgcggcggtgagtgcaccctcgccctcgccggtggtgtcaccgtgatgtccatcccggacaccttcatcgagttctcccggcagcgcggactggcccccgacggccgctccaagccgttctccgagtccgccgacggcgtcggctggtccgagggcgtcggaatgctgctcctggagcgccagtcggacgccgtgcgcaacggccaccagatcctggccgtggtgcgcggctcggcggtcaaccaggacggtgcgtccaacggcctgaccgcgcccaacggcccgtcccagcagcgggtgatccgtcaggcgttggccagcggcggcctgtccacggccgacgtggacgccgtcgaggcgcacggcacgggcaccacgctcggtgacccgatcgaggcccaggccctcctggccacctacggccgcgaccgcgaccccgagaacccgctgctgctcggttcgatcaagtccaacctcggccacacccaggcagccgccggtgtcgccggcgtcatcaagatggtcatggcgatgcggcacggcgtgctgccccgcagcctgaacatcaccgagccgtcctcgcacgtcgattggagcgccggcgccgtcgaactgctcaccgagcagaccgcctggccggagaccggccgggcccgtcgcgccggtatctcctccttcggcatcagcggcaccaacgcccacgtcatcctggagcagccggaggccgcgcggcactcggcgccggaagaagccgacacggcggaggcagccgccaaggcgccggccaccgcgcacctgcccgtaatgccgtgggcactgtccggcaagacgccggaggccctgcgtgcccaggccgcacgcctcctcgcccacctccagcagcgccccgaactcgcacccgccgacatcgccctgtccctcgccacccagcgctcccagttcacccaccgggcagtcgtcctgagcaccgaccgtgacgaggcgacccgcgcgctgtccgccctcgccaccaccgccgcgtccgacccctcggccctcaccggcacggtcaccatgggacgttgcgcggtgctgttctcgggtcagggctcgcaacgtctgggcatggggcgtgagttgtacgagcgtttcccggtcttcgccgaggctctcgatgtcgtgatcgatcacctggacgccgccttgcccgcccaggccggtttgcgtgaggtgatgtggggcgacgatgtcgagttgctgaacgagacgggttggacccagcccgcgctcttcgccatcgaggtggcgctgtttcggctggtggagagttggggtgtccgtccggacttcgtggccggtcattccatcggtgagatcgcggcggcgcatgtcgtcggggtgttctcgttggaggacgcgtgccgtctggtggccgcgcgggcgacgctgatgcaggcgttgccggccggtggcgcgatgatcgcggtccaggcgaccgaggacgaagtcatcccgcacctgaccgacgaggtggcgatcgcggccgtcaacggcccgacctccgtggtgatctcgggcgcagaagaggccacgcagaccgtggcacaacacttcgccgaccaggggcgccggacgaccgcgctgcgggtctcgcatgcgttccactcgccgctgatgatgctggcggagttccgtgcggtggccgagggcctgtcctacgccaccccgaccctccccgtcgtctcgaatctgacgggccaggtggccacggccgacgaactctgctcggccgagtactgggtgcgccacgtccgtgaggcggtccgcttcgccgacggtgtgacggccctcgaagccgagggcgtgcggaccttcctggaactcggcccggacggcgtcctcgccgccatggccagggaaaccgtcgccgacgacacggtcaccgtccccgtcctccgcaggaacatgcccgaggaacggaccctgctcaccgcactcggccggctccacaccaccggaaccccgatcgactgggccgccctcctggccccgaccggcgcccgcccggtggacctgccgacatacgcgttccaacaccgtcccttctggccctccggcccccgcgacaccgcggatgccgccgccgtcggcatcgccggcgcgagccacccgctcctcaacggcatcgtcgaactcgccgacgaagagggcctgttgttcaccggacggctgtcactgcagtcgcatccgtggctggccgaccacgccgtcatgggacaggtcctgctgcccggcaccgcactgctggaactcgccctgcgcgccggcgacgaggtcggctgtgaccacgtcgaggaactgacgctcgccgcaccgctcgtcctgcccgagcgcggcgcggtacagacccaggtccgggtcggcgtcgccgacaccaccgggcgccgcaccgtcacgatccactcgcgtcccgcacgcgccacgaccaccgacagtgacacccacaccggcaccgacaccccgtggacccaacacgccaccggcgtcctcgtcgccggcctgccggcgacggcaaccgtcccgttcgatgccaccgtgtggccgccggcgcacgccgaacccgttgacctggcggacttctacgcgtcccgggccggcgaaggattcggctacgggcccgctttccagggcctgcgagcggcctggcgccgcgacggcgaggtgttcgccgatgtcgcactgccggaggccggccgtaccgaagccgaggcgtacgggctgcatccggcactgctcgacgccggactgcacgcagcctggctcgtcgccccggacggggagcccacacggacgggcagcgtgccgttctcgtggcgcggcgtcttcctggccgcttccggtgcctcctcggtccgcgtccgactcggccgcgactccgacggaacgctgagcctggccatcgccgacaccaccggtgcaccggtcgcgtccgtacaggccctctccatgcgcaccgtctcggtgacggccctgagcgccaccgcgggcctcgcccgcgacgcgctgttccgcctggactgggcctcggccccggagccggcgtgccagccggacgacacggtgaccgtgatcccggcggtcgcggtcgtcggtacggaaacctccgaactcacctccgagctcaccgcggccctgcgtgcggcgggcgccgacgtcgacgtccgcacgaccctgtcgaccgatgaacccgcgcccgcgctgatcgcgctgccgctcgtcgcctccgaccagaccggcaccgcagaagcggcacccgtcccggcggccgtgcacgacctcacccgccgagccctggccctcgtacagacccgcctgcaagagcagcacttcgcggacacgaagttcgtcttcgtgacccgtggtgcgacggtcgggcgtgatgtggctgctgctgcggtgtggggtctggtgcgttcggcgcagtcggagaatccgggttgttttgctctggtcgatctggatccggatggtgcggtgggtgcggctgcgctcgtcgctgcgttggtcagtggtgagccgcagcttgcggtgcgcggtgatgtgttgcgggtcgcgcgtctggtgcggcggccgctcaccgaggtcggtgcgggtgctgatggcaccggggatggcgtcgggggtggctctggtgtgtcgttctcgggtgagggtgcggtcctggtcactggtggtacgggtggtctgggtgcggtgttggcgcgtcatctggtggccgagtatggggtgcgggatctgctgttggtcagtcgcagtggtgaacgtgccgtgggtgctggggagttggtggcggagcttgcgggtgtgggtgcgcgggtgcgggtggttgcgtgtgatgtgaccgatcgtgccgcggtggtggagttggttggcgggcatgcggtgtccgcggtggttcatgcggctggtgtgctggatgacggcatggtgggtgcgttgaccggggagcggttgtccgcggtgctgcggccgaaggtggatgctgtctggcatctgcatgaggcgacccgcggcctggatctggacgcgttcgtcgtcttctcctctctcgccggggtcttcggcagtcccggccaggccaactacgcggccgcgaacgccttcctggacgcgctgatgacgcggcgccgggcggagggactgcccggcctgtcactcgcatggggaccgtggtcgctgaccgatggcacatcgggcatgctcgcggacgccgaggccgatcgcctgacccgttcgggagtgccaccgctgaccgcggagcaaggactggcactgttcgacgcggccctggcgaccggtgacgccacctgcgtcccggtccgcctggacctgtcggcactgcgtgcccagggtgaggtgccgcccttgctgcggtccctgatccgaggccgctcgcgccgcgccgccgccgcggaatcggcaaccgccaccgggctgcgggaacggctcgtcggactgaacccggtcgagcgacaggaagtcctcctggacctcgtgcgcggccaggtggccctggtcctcggccacgccgacgccgacgacgttcatccggcacgtgccttcagggagttgggcttcgactccctcacctcggtggaactgcgcaaccgcctcaacaccgtcaccggtctgcggctccccgcgaccatggtgttcgactatccgaccgtcgaagtgctggtctcctacgtcctggacgagttgctgggcacggatgccgaggtggcgaccgtgcagccggccgcggttgcggtggcggacgatccgatcgtcatcgtgggcatggcctgccgctaccccggcggggtcgcctctccggacgacctgtggaggctcgtcacggacggcgtcgacgcggtgtcccccttcccgaccaaccgtggttgggacgtcgaatccctctatcacccggaccccgaccatctcggtacctcctacacgcgctcgggtgggttcctgcatgaggcgggggagttcgatccggggttcttcgggatgagtccgcgggaggcgttggcgaccgattcccagcagcggttgttgttggagtcgtcgtgggaggcgatcgagcgggccggtattgatccggtgagtttgcggggtagtcggacgggtgtgttcgcgggggtgatgtacagcgattacagcgcgatgttggcgagtccggagttcgagggtttccagggcagtgggagttcgccgagtttggcgtcgggtcgggtggcctacacgttggggttggaaggcccggcggtgacggtggatacggcgtgttcgtcgtcgttggtggcgatgcactgggcgatgcaggcgttgcgtagtggtgagtgtgggttggcgttggccggtggtgtgacggtgatgtcgacgcctgcggtgtttgtggactttgctcggcagcggggtttgtcgccggatggtcggtgcaaggcgtttgcggatgcggccgatggtgtgggctggtccgagggcgtcggcgtgttggtcctggagcggcagtcggacgcggtgcgcaatggtcacgagattttggctgtggtgcggggttcggcggtcaaccaggatggtgcgtccaatggtttgacggcgcccaatggtccgtcgcagcagcgggtgatccggcaggcgttggccagtggtggtctgacggccggtgacgtggatgtggtggaggcgcatggtacgggtacgacgctcggtgatccgatcgaggcgcaggcgttgttggcgacgtatgggcgggatcgtgagcctgagcggccgttgttgttgggttcggtgaagtcgaatctggggcatacgcaggctgctgcgggtgtggcgggcgttatcaagatggtgttggcgatgcggcatggtgtggtgccgcggacgttgcatgtggatgcgccttcttcgcatgtggactggtccgagggtgcggtggagctgctcagtgagcaggcggcttggccggagacgggtcgggtgcggcgggcgggtgtctcctccttcggcatcagcggcaccaacgcgcacgtgattctggagcgtccggaggccgcgcggcgtccggtgatggagacgaacaccgtggagccgtccacggtgccgtgggtgctttccggcaagacaccggaggccctgcgcgcccaggcggcgaaactgttgtcgtcgatcgaggaacgcccggagcttcgcctcgtcgacgtgggaatgtccctggtcaccggccgctcgacctttgaacaccgtgcggtggtactcgccgccgaccgtgccgacgccgcccgcgcattgtcggcgattgctgccgacgaggccgatgctgccgctgccaccggccgcgtcggcgcgggtcgtcacgcggtgctgttctcgggtcagggtgctcaacgtctgggcatggggcgtgagttgtacgagcgtttcccggtcttcgccgaggctctcgatgtcgtggtcgaccacctggacgccgccttgcccgcccaggccggtttgcgtgaggtgatgtggggcgacgatgcggagttgctgaacgagacgggttggacgcagccggctctgttcgccatcgaggtggcgctgttccggctggtggagagttggggtgtccgtccggacttcgtggccggtcattccatcggtgagatcgcggcggcgcatgtcgccggggtgttctcgctggaggacgcctgccgcctggtggccgcccgtgcgacgctgatgcaggcgttgccggccggcggtgcgatgatcgcggtccaggcgaccgaggacgaagtcaccccgcatctgaccgacgacgtagcgatcgccgccatcaacgggccgaacgcactggtcgtatcgggtgtggaggatgccgccgtcgagatcggggcgcggttcgcggccgaggggcgtcgcacgacccgactccatgtgtcgcatgcgttccactcgccgttgatggatccgatgctggcggagttccgtgtggtggcggagggcctgtcctatgctgctccgtccctccccgtcgtctcgaatctgacgggccaggtggccacggccgacgaactgtgctcggccgagtactgggtgcgccacgtccgcgaggcggtccgcttcgccgacggggtgacggccctcgaagccgagggcgtgcggaccttcctggaactcggcccggacggcgtcctcgccgccatggcaggagcctcgctcaccgaatcctccctcgcggtaccgctgctccgtaaggaccggccggaggaaccggcggcactcgccgccctggcccagttgcacatcgccggcgcgcgcgtcgattggcccgtgctcttcgctggtgtgggtgcggggcgggtggagttgccgacgtatgcgttccagcgtgggtggttctggccggttggtcgggttggtgttggtggtgatgtgggtgctgtggggcttgggtctgcggggcatccgttgttgggtgctgcggtggagttggctgcgggtgcgggggtggtgttgacgggtcgtctgtcgttgtcgtcgcatggttggttggctgatcatgcggtgatggggcgggtgtttgttcctggtacggcgttgctggagatggtgatgcgtgctggtgatgaggtggggtgtggtcgtgttgaggagctgacgttggcggcgccgttggtgttgcctgagcgtggtggggtgcgggttcaggttgctgtggatgctcctgatgctgcgggtcgtcgtggtgtgggggtgtattcgtgtcctgatggtgtgggtcaggcggtgtggtcgcagcatgctgtcggtgtgttggcctctggtgtggctgaccaggtcggtgggttcggtgacggtggtgtgtggccgccgcagggtgcggtgtcggtggatgctgagggctgctacgagctgtttgcggatgctgggttcggttatggcccggtgttccaggggttgcgtgcggtgtggcgtcgcggcgaggaactcttcgcagaggtcgccctgtcggacgaggttgctgagagcgctgatacggcgaccggtttcgggttgcacccggcgttgctggatgcctcgctccatgcctcgcttctctcctcccttgaaggtcaatccgccgatggtgggcctgcgttgccgttcgcgtgggagggtgtttccctcttcgcctcgggtgcgacggctttgcgcgtgcggttggcgccggcgggtgagcatgcggtgtcggtgaccgcggtggatccgaccggtgcgccggtgatttccatcgacgcgcttcgtacccgtcgcctcaccctcgatgaggtcaacgcatctcacacccagctgagcgatgcgctcttcggcgtccaatggaccacggtcccgagcaccccggccgccgaccacccgtcggtagccatcatcggaaccgaccacctggggctcgccgaagcgctcagcagttcctctgctggcgcgaccacgaccacgaccgcggccgcgtacgagagccttgacgcgctgatcgcggcggggcccgaagtgtccgtccctgacgtcacactcatcggtctcaccaccgaggacgccatcgctcagtacgtgaacgaccacgacgccacggtggccggccaaggcaccatcggagccggcgcggcggccgtagacgcggctcgccgcctcaccgccgaggccctgcgcacgatccaggcatggttggccgacgagcgtctggcggcaaggcgcctggtcttcgtgacccgcggcgcggccgacgggcaggatgtcgccgcggcggccgtccagggcctggtgcgctccgcccagaccgagaacccgggcaccttcggcctcctcgacctcgacgggaccgaggcgtcgaccgcggtcctcggcgaggctctcacctccgacgaaccgcaactgcttctgcgcgacggacacctgcacgccgccaggctgacccgcctggcgtcgcccgccgacacggccgtgcccacggagtggaacgcggacggcacggtgctgatcaccggtggtaccggcgggctcggcgcgcagttcgcacggcacctcgtcgacaggtacggcgtccgcaatctcctgctcgtcagccggcgcggccccgatgccccgggaaccacggagttggtcgccgagctgacggcgcacggtgccgaggtggccgtgcaggcatgtgacgtggccgatggcgatgcggtggcggcgttggtcgccggcgtgccggatgagcacccgctgagggcggtcgtccacacggccggtgtgttggacgacggagtgatcggctcgctcaccgaggagcggctcgccaccgtcctgcggcccaaggcggatgccgcctggcatctgcacgaagcgacccgcggcctggacctggacgcgttcgtcgtcttctcctccgtcgcaggggtcttcggcggcgccggccaggccaactacgccgcggccaacgccttcctggatgcgctgatggcccagcgccgggcagcgggcctgcccggactctcgttggcctgggggccgtgggaccagaccggcggaatgacgggcatgctgtcggacgccgaggccgaccgcctcgcccgctccggcatcccgccgctctccgcggagcagggcctcgccctcttcgacgcggcactcgctcttgccggaaccagcacgccagacagggcagccggcagcgccgccgccagcacgtcgggaaccggcgacacgatcgccatcccggccgcggccctcgtcgcaccggtccggctcgacctggcggcgctggccgcgcagggtgaggtccccgcgattctgcgcggactggtgcggacccgcacccgccgtacggcggccggcggttccgtcaccgtggccggactcgtcaaccgcctgtccgggctcaccgccgacgagcggcgccaggaacttctcgaactggtccgcactcaggcagccctcgtcctcgggcacgccgatccggcgtccgtggactccaccgcacagttccgtgacctcggcttcgactcgctgaccgccgtcgagctgcgcaaccggctgagcacggccaccggcctgcgcctgaccgcaaccctggtcttcgactacccgaacaccgatgccctcgcggagcacctgcgggacgagttgttcggcgcggtcgagagcgaggtgcgggtgccggtccaggcactgccgccgaccgccgacgatcccatcgtggtggtgggcatggcctgccgtttccccggtggtgtgacctcgcccgaggacctgtggcgcctggtcgacgccggcaccgacgccatcaccaccttcccgaccaaccgcggctgggacctcgaatcgctctacgacccggaccccgcacacctcggcacctcctacacccgctccggtggcttcctgcacgaggcgggggagttcgacccggcgttcttcggaatgagcccgcgtgaggcgctggcaaccgactcccaacagcgtctcctgctggaatcctcctgggaggcgatcgagcgggccggcatcgacccgctgaccctgcgcggcagcgccaccggcgtcttcgccggcgtgatgtacagcgactacgggagcatcctcggcggcaaggagttcgagggcttccaaggccagggaagtgcgggcagcgtggcctcgggccgcgtctcctacaccctcggcttcgaaggtcccgccgtcaccgtggataccgcctgctcctcctccctggtcgccctgcacctggcagcccaggcccttcgggcgggtgagtgcacgctcgcgctcgccggtggtgtgacggtgatgtccacgccaggcacgttcgtggagttctcgcggcagcggggtctggcgcctgatggtcgttccaaggcgttcgccgaggccgcggacggcgtcggctggtccgagggcgtcggcatcctcgtcctggagcgccagtcggacgccgtgcgcaacggccacgagatcctcgccgtgatccgcggctcggcggtcaaccaggacggtgcgtccaacggcctgaccgcgcccaacggcccgtcccagcagcgcgtcatccgtcaggcgttggccagtggcggcctgtccacggccgacgtggacgccgtcgaggcgcacggcacgggtacgacgctcggtgacccgatcgaggcccaggcgctcctggccacctacggccgcgaccgcgaccccgagaacccgctgctgctcggttcgatcaagtccaacctcggccacacccaggcagcggccggtgtcgccggtgtcatcaagatggtcatggcgatgcggcacggcgtgctgccgcagaccctgcatgtcgacgcgccgtcctcgcacgtcgattggagcgtcggcgccgtcgaactgctcaccgagcagaccgtctggccggagaccggccgggtccgtcgcgccggtgtctcctccttcggcatcagcggcaccaacgcccacgtcatcctggaacagccggaggccgtgcagcgcctggcaccgggagcagcagagaccgtggagccggtcgccatcaagccgtcggcggaaccgtccctggtgccgtgggcgctgtccggcaagtcacccgaggccctgcgcgcccaggccgcacgcctccgtgacttcctggcggaacggcccgaaccgcgctcgatcgacatcggccactcactggccgtcacacgctcgcagttcgaccaccgcgcgatcgtgctggtcgacgatgcgaaggccccggcggacagcctggccgccctcgcggccctggcctccggtgtggccgatcccgccgtcgtctccgacgcggtatcgaccggcggttcggcagtgctgttcacaggtcagggtgctcaacgtctgggcatggggcgtgagttgtacggccgtttcccggtcttcgccgaggctctcgatgtcgtggtcgaccacctggacgccgccttgcccgcccaggccggtttgcgtgaggtgatgtggggcgacgatgtcgagttgctgaacgagacgggttggacccagcccgcgctcttcgccgtcgaggtggcgctgttccggctggtggagcgttggggtgtccgtccggacttcgtggccggtcattccatcggtgagatcgcggcggcgcatgtcgccggggtgttctcgctggaggacgcctgccgtctggtggccgcccgtgcgacgctgatgcaggcgctgccgaccggcggcgcgatgatcgcggtccaggccaccgaggacgaagtgaccccgcacctgaccgacgaggtggcgatcgcggccgtcaacggcccgacctccgtggtgatctcgggcgcagaagaggccacgcagaccgtggcacaacacttcgccgaccaggggcgccggacgaccgcgctgcgggtctcgcatgcgttccactcgccgctgatggatccgatgctggcggagttccgtgcggtggcggaaggactgtcctacgccaccccgtccctccccgtcgtctcgaatctgacgggctggctggccacggccgacgaactgtgctcggccgagtactgggtgcgccacgtccgcgaggcggtccgcttcgccgacggcatcaccaccctcgaagccgagggcgtgcggaccttcctggaactcggcccggacggcatcctgtccgcgctggctcagcagtccctcgccggcgaagccgtcaccgtgcccgtcctgcgcaaggaccgcggtgaggagtccacggccctgacggcccgagcgcatctccacacccgcggactgatcgaagactggcaggacttcttcgctggtgtgggtgcggggcgggtggagttgccgacgtatgcgttccagcgtgggtggttctggccggttggtcgggttggtgttggtggtgatgtgggtgctgtggggcttgggtctgcggggcatccgttgttgggtgctgcggtggagttggctgcgggtgcgggggtggtgttgacgggtcgtctgtcgttgtcgtcgcatggttggttggctgatcatgcggtgatggggcgggtgtttgctcctggtacggcgttgctggagatggtgatgcgtgctggtgatgaggtggggtgtggtcgtgttgaggaactgacgttggcggcgccgttggtgttgcctgagcgtggtggggtgcgggttcaggttgctgtggatgctcctgatgctgcgggtcgtcgtggtgtgggggtgtattcgtgtcctgatggtgtgggtcaggcggtgtggtcgcagcatgctgtcggtgtgttggcctctggtgcggctgaccaggtcggtgggttcggtgacggtggtgtgtggccgccgcagggtgcggtgtcggtggatgctgagggctgctacgagctgtttgcggatgctgggttcggttatggcccggtgttccaggggttgcgtgcggtgtggcgtcgcggcgaggaactcttcgcagaggtcgccctgtcggacgaggttgctgagagcgctgatacggcgaccggtttcgggttgcacccggcgttgctggatgcctcgctccatgcctcgcttctctcctcccttgaaggtcaatccgccgatggtgggcctgcgttgccgttcgcgtgggagggtgtttccctcttcgcctcgggtgcgacggctttgcgcgtgcggttggcgccggcgggtgagcatgcggtgtcggtgaccgcggtggatccgaccggtgcgccggtgatttccatcgacgcgcttcgtacccgtcgcctcaccctcgatgaggtcaacgcatcccacacccagctgagcgatgcgctcttcggcgtccaatggaccacggtcccgagcaccccggccgccgaccacccgtcggtagccatcatcggaaccgaccccttcggcctcgcagacggcctttcggacgccttgcccctggtcgaggagcgcggtgacctcgcggcgctcgcagcgtcggagcacccggtaccggacctcgtcctcgtcccggtagcgggcacccggcgcacaggcgtacctgcggacgccgaaggacacaccgacgccgggacatccgacatgctccgatccgtgcgtgaggccaccgcacaggtactggagcagatccagcagtggttggcggacgaccggttcgaggcggcgcggctggtgttcgtgacgcgcggggcggtttccgtgggtgagggcggcatcgccgacctggcggcctcggccgtctggggtctggtgcggtcggcgcagtcggagaatccgggctgcttcggtcttctcgacctcgacctcgacctcgcccttgactccgaccttgcccccgaggtcgacatcgagcgcgaccgtgaccgcgatccggtcggtgggaccgtgcagcccgcgctcgccgcggccctgcacgcgaccgccgacgagccgcagttggcactgcgcggcgggaccgtgcaggccgcccgactgacccgaatccccgcgccgcagaccgaccgtgccgagaccgaccctgccgagaccgaccgtccggagatcgacacccggcggcccggcacggtgctcatcaccggtggtaccggtggcctcggtgggttgctcgcccggcacctcgtcgccgagcggggggtacggagcctggtgctcgccagccggagcggtctcgcggccgagggagcggagaagctggtcgccgacctcgaagcgctcggtgccgtggtggccgtgcagacgtgtgatgtggccgatggcgatgcggtggcggcgttggtcgccggcgtgtcggacgagtacccgctgacggcggtcgtccacacggccggtgtgttggacgacggagtgatcggctcgctcaccgaggagcggctcgccaccgtcctgcggcccaaggcggatgccgcctggcatctgcacgaggcgacccgcgatctggacctggacgcgttcgtcgtcttctcctccctcgccggcgtcctcggtggcgccggtcaggccaactacgcggcggcgaacacgttcctggacgccttgatggcgcagcgtcgcgccgccgggttgccgggtgtgtcgctggcgtggggtccgtgggaccgggccggcggcatgacggggaccctgtcggacgccgaggccgaccgcctcgcccgctccggtgttccgccgatctcggcggagcagggccttgcgctgtacgacgcggcgaccgccggtgagcggccgctggtggtgccggtgcggctggacctcgccgcgctccgcgggctcggtgatgtcccggcgctgctgcgcggactggtccggacgcccgcgcggcggaccgcggcggccggtgcggcgccgtcggccgatgtgctcacccggcagttggccgggctcggcggggcggagcaggaggaggtcctgctgaggctggtgcgcggtcaggccgcggtggtgctcgggcacgccgacggctcggcgatcggtgcggggcgacagttccaggagttgggcttcgactcgctgaccgcggtggagttccgcaaccgactcaacgcggccaccggactgcggctgccggccaccctgctgttcgactacccgacgccggccgacgtcgtcgggcacctgcgcggccggctcggcaccggggaggtgtcgggtgcgggctcggtgctggcggcgctggacaaccttgaggcggtgatcgccgggctgtccctcgacgacgcgggggagcaccagttggtggccggccggctggaggtcctcagggcgaagtgggcggacatgcgaagcgcggagggagctgtggacggcggtgcggacgtcgacatcgaggaggcgtcggacgacgacatgttcgcgctgctggacgacgagctggggctgaactgagccgctccgcatgagcagttccgcaccagaagttccacagtggcctggtccacagtgacctggtccacagtgagctgttccacagcgacctgttccgcggcggttccgtagtgagccgttccgcttaggcgggaaaccggggccccggtggtcggacgcttgattccggccaccgggagcgtcaaaccggcctcttctaaagaaagggaaagaactagggaaacacccacagcccgatcatgtgcaatgaattccgtggctcggaaaaccattcgcgggccatggagttacggtgtgatcacgtgtccgtacggcagtgacggcgtgcacgggttgccacggcaggtccccggccgaggcgtctccccgctgctgcccggcggtgcgtgccgcttggttcgtccctaggaggtccccccatgaccacgtccaccgaggagagcctgtgggcccggtgcttccatccagcaccggccgcccccgtccggctcttctgtttcccacatgcgggcggctcggcctccttctacttcccggtgtcggcccaactgtcctcggttgccgaggtgttcgccatccagtacccggggcgccaggaccggcgcaaggaagccggtgtcagtgacctcgcgaccttggccgaccaggtctacgacgcgctgcgccccctgctgaaggagcggccgagcacgttcttcgggcacagcatgggcgcgacgctggccttcgaggtggcccggcgcttcgaggccgacgacggtgacctggtccggctgttcgcctccgggcgccgggccccctcccgcgtgcgtgaagaggccgtgcaccggcggtccgacgacggcatcgtcgaggagctgaagctgctcgccggcaccaacaccgcgctgctcggcgacgaggagatcctgcggatgatcctgcccgcgatccgcagcgactaccaggccatcgagacctaccgctgcccgcccgacgtcaccgtccgggcgccgctgaccgtcctcaccggcgaccgcgacccgaagacctccctggacgaggccgaggcgtggcgcggccacaccaccggggacttcgacctcaaggtgcttcccggtgggcacttcttcgtcagctccgaggccccggcgatcatcgatctgctccgggcgcacctcgccggcaacggctagcgggcgcactgcggcaggccggcggtgccggtctgccgcacggcccccgcgccgcctgagacggcaccatgccacccggcgacgcgcgttgcgtgcgcctgtggagcaccgtcccgcgtgcgtacgcgggcgcgcggaggacgtgctcggccggccggatgtcctggaggagaccattcggaaaacgtcaaatgtctgacagctgctgctcatttactccagcccgcactatatgatcttgtggtggggcatgtacggagcgtgccactcgttcgctcctggtgcatccatcccgaccgtccggatttgtgtgcaccggacggccgtggtcctggtacgcgtcggcgcgaggtcggctcctgttctcaccccacgtggaggaacgcgtgatgcggaagcagtcgggttcttccggcttactgaccacgctggtgggacgcgacgacgaactgcgcaccctcgcccggcacgccgcggccgcccgcgacgggcgggccggcctggtcctgctccacgggcccgccggcatgggcaagaccagtctgctgcggtccttcacggcgagcgatgtctgccgcggcatgacggtgctgtacggcacctgcggcgagaccgtcgccggcgccgggtacggcggtgtgcgcgaactcctcggcgggctcggcctgagcggcggcgacgcccggcgctcgcccctcctggagggcctggcggcccgcgcgctgcccgcactcaccgcagaccccgccggtcccgacgccgccacgggtgcctacccggtgctgcacggcctgtactggctcgccgcccgcctcatggcccaacggccgctggtcctcgtcctcgacgacgtccactggtgcgacgaacgctccctggcctggatcgacttcctgctgcgacgcgccgaggacctgccgctgctggtcgtcctggcctggcgcagcgaggccgaaccggtcgcgcccgcggtgctcgccgacatcgccgcccagcgccgccccaccgtgctcggcctgcacccgctcggccccgacgacataggcgaaatggtgcgtcgcgtcttccggaccacggccgcaccgtcgttcgtcagccgggtcgccgccgtgtccggcggcaatccgctggccctcgcccgcctcctcgacgaactccgcgccgagggcgtccggccggacgccgccggggagcgccgggccgccgaggtcggcagtcacgtcctcgcccgctcggtgcgctgcctgttggagcgccggccgccctgggtgcgcggcgtggcccgtgccatcgccgtactcggcccggagtgcaccgagttgctggcggcgctcgccggcgtcccggccgcgaccgtcgacgaggccctgttggtgctgcgcagggccggcatcctggccgccgaccgcgtggacttcgtccatgacgtcgtccgctccgcggtgctcgacgacgtcgccccgcccaccctggccgaactgcgcaccaacgccgcgctgttgctgagcgacgccggccgcccctccgaggagctcgccggccagctcatgctgctgccggtgctcgaccagccgtggatggccgcggtgctgcgcgacgccgccgcccaggcggagagccgcggcgccccggaggccggtgtgcgctgcctctaccgggtgttggaggtggagccggacaacgttgccgtccgcatccagatggcccgcgcgctcgccgagatcaacccgcccgaggcgatgcgcctcctcaaggaagcgctctccctcgccggggacgtccgcacccgcgcccaggtcgccgtccagtacggcttcacctgcctcgccgtgcaggaatccccgtccggggtgcggatgctggaggacgcgctcgccgagctgaccgccgaactgggccccgaaccagggcccgtggaccgggagttgcggaccctcgtggagtccgtgctgctcatcgtcggggccgacgagaaggtgacgatcggtgcggtccgcgaccgggcggcccggctcaccatgccgcccggcgacacaccggcccagcggcagatgctggccatgaccaccgtgctgaccgcgatggacggccgggacgcccggtcggccgtcgaccaggcccgccgcgccctgcgcgcacccggcgtcgagctggaaccctggtcgctgctgtccgcctccttcgccctctccctggccgacgaggtcgccgacgcgcagtacgcactggacctcatgctccagtacggccaggacaacgcggcggtgtggacgtacgtcctggcgctctccacgcgcgccctgctccaccacggggtgggcgccttccccgaggccctggccgacgcccagaccgccgtcgagatcctcggcgaggagcgctgggcggacggcgccgtgctgccccgtgtcgcgctggccaccgccctcgtcgaccgcggcgagcccgagcgcgccgaacacgtcctcgacggcatcacccgcccccgcctcgaacgcttcgtcatcgaataccactggtacctccaggcccgcgcctacgcccgctgggtccgcggggatttccaaggagccctggacctccttctcgcctgcggtcggtccctggaggagtcgcgcttcagcaacccggcgttcgtgccgtggtgggccgatggcgcggtgctcctggcgaccctggaccgccacgaccaggcgcgcgaactcgccgcatacggaagcgagttggccgagcgttgggggacggcgcgcggcctcggactggccttcatggcccagggcgtcgccgcacccggccgcgccggcatcgatcacctcaccgaggcggtctcgctgctcgcggactccccggcccgggccatggaggcccgggccgaacttcttctcggacacgcccacctgaagcgcgacgacctgcgggccgcccgggaacacctgcgcgccgccgccgacctcgcccagcgctgcggcgccgtgaagctcggcgtcgacgccagaaaactgctggtcaccgcgggtggtcgggtacgcaggatgaccgcctccccactcgacatgctgaccgggatggaacgcacggtggcggacctcgcggtgaccggcgcgagcaaccgggccatcgcggaagccctcttcgtgactgtaaggaccatcgaaacccatctcacgagcgtctaccggaagctcggggtcggcgggcgtgcggagctgtccgccgtcctggagaccaggaccgccacctccggtcggcagccgccggcctgggtctcccaggcacgcggacgcgcttgagacgaacaggacgagaggtagcggtgccccggagcaaggcgcggaaccaaccgaccacctgcacgccgcagtgcgcacccgacgcccacggcgaccccaccatgctcctcgaatgcggccgggaacagcggctcatcggcgacctcctgcaccgcctcggccaggggcggccatcggtgctcagcctgaccggccggcccgggcacgcccagaacgccctggtccgctggggcgcgtgccgggccaggcacgacgggctgcgcgtcctgcgagcccaggcgacgcccgcggaacgggaactccgctacggcgccgttctccaactgctggccgtcctcgacggcccgcacggcagcaccctggacgccgcgatccgccacgacggtcccccgccactgcccgtgcccggcatcgaggaggtgctgcggcgcaccggcacggcacccaccctggtcgtggtcgaagacgtccagtggttggacccggcctcgctgacgtggttgcagatcctgctgcgccacctcgggccggacaccccgctcgccgtcctggccagcagctgcggtgacaccacggccttcgacaccgacccgaaggcccccgccgtcccggggccgccggacaccgtgcccgtcgcgcgcttcgtggtgcccgcgctcaccgaccgcggggtcgccgccaccgtccgcgccgtctgcggcacccccggcgacgaggagttcatcgccgcgctcacctccgccaccgccggcaaccccgccatcctgcgggacgccctgcgcgccttcgtcgaccacggcctccccgccgacgccgaccacctcccggagctgcacgccctcaccgctggcgtcgtcggcgaccacaccgtgcgcgccctggacggcctgcccgccgaagtcaacgccgtcctgcgggccctggccgtctgcggcgacctgctcgacttccaccgagtccgggccctcgccggcgcgcactcgctgtccgaggaccggatccgcaccctgctggcgagcgtcggcctgaccgtgtccgtcggcgacaaggtgcacatccgcttccccgcctccaaggcacgcgtcatcgaggacatgcccgccgcggagcgcgccgatctgtacgtccgcgcggccgaactcacccacagttgcggcgtcaacgacgaggacgtcgcccatctgctgctgcgctcgtcgccgctcggcgcaccctgggtcgtgcccctgctccgccgcggattcgccgccgcgctgcgccgggaggaccaccaccgggcctgtgcctgcctctcccgcgccctgcaggaacccctcgacccccgggaacgcagcctgctgacgttggaactggccgcggccgaagccgtcgcccggccggaggcgggggatcgacgcctgggggaactcgtccgcagcaccgtcgcggacaccgaccccacgtcgtccggtgagggggtgggggtccgcgccatcgacctggggttcgcccggggcaacagcgaatgggtccgccgcaccgcgggcgaggccctgccgtacgccgggccggccgaccgggaggaactggtcgcgctgttctggttggccgccgtgcgggacgacgacgcgccgatgatccccgtggtgccccggttgcccgaccggccggtgccgccggcccaggccggcgcccgtgcctggcagctggccacggcgggggaggacgcggacaaggccaggaagctcgcccggatcgccctcaccggcggggtgaacgagagcctgatgatgccgaaactggcggcctgcgccgcgctgttcgccaccgacgacaacgacgaggcggtgcacggcctggacaccatgctcaccgccgcccgcagtgcccacctgcgcagcatggccgcccgcattttcaacctacgggcccggatacacctgtgcgcggcccggctggaggccgccgaacgcgatctggacagcgccgagcgcgccctgccgccgacgagttggcacccccgtgcgctgcccaacctgatcgccacccgcatcctcgtcagcatggagacgggccgcccggaccgggcccgccgactcgccgaggccccggtccccgccggcggcgaggagggtgtgtggtggcccgccctgctgctcgcccgcgcccgtgtggccgccgacgacggtgactgggaggaggccctgcggctgtcgcgggagtgcgggcgctggctttttcgccggcactgggccaacccggccatgctcagttggcgcccgctggccgccgaggcgtgtctgaagctcggcgacgtgacggaggcgcgccggctgcgggacgaggagctgttcttcgccgaccgctggggcaccgcgagcgcccgcgggatcgcccgcctgacgacgcggcgactcttcgacgacgacggcgaccgggccgtccggcggatccgcgaggccgccgccctgctccgcgactcgcccgcccgcctggcctacctgtggagccggctgagccaggccggtgccgagacggcccacggcgacaccgccgcggccgcacgctcctggcaggcggtcgcccggatgaccgccgcccaccccgccagccgcctcgccaccgccgcccgcaccctgaccgtcccgtccgttccggtcgccaccgcgccgcccaccgccgtcgtcccacccggatggcgcgacctgtccgaggcggagaaggacaccgtgctgctcgccgcccgcggccacggcaaccgccagatcgccgaacaactcgccgtcagcaggcgcaccgtggagctccggctgagcaacgcctaccgcaagctgaggatcggcggacgcaaggagctgtacctgctcctggaggcgctggaaggaccggtcgcggatgcttcttgagcgggagaacgaactggcccggatccgggccgccctggacgccgcggaagcgggcgactcctcgctcctcctgatcaacggtcccctcggcagcgggcgttcggcgctgctgcgccggataccggagctggccggcgacggcacccgcgtcctgcgggccagcgccgcctggcgggaacgcgacttccccttcgggatcgcccgccaactcttcgaccacctgctgtccggggcgggcggcgcagggccggccgaacgcaccgccggggcagagcacttcagccgactgatggacaccggcgaccgccctaccgggaccggccccgccctggaggtctcccaggcagtgctccagggcgcccaggcgctgctcgccgacgcgtccgcggagcggcgcctgctgatcctggtcgacgacctccagtgggccgacggcccgtccctgcgctggctggcccacctcacccggcggctgcacggcctgcgggcgctgctggtgtgcacgctggccgacggcgaccaccggggcaggtaccccctggtccgggaggtcgccggcgccgcgcacaccgtcctgcgcctggcgccgctgtcccgggacgccacccgcgtcctgctcgccgggccccagggccggccgccgcaggacgcactggtgcgcgccgtgtacgaggcgtccaggggcaacccgctgttcctgaccgccttccggagcgctctgcgcgccaccggaaggccgcccggcggcgaccacttcggcgccgtccgggagctgagcccgacggtgctgcgcgatcggctcgcgggccatctgcggatccagccgcagccggtgcgcgaggtcgcggtggcggtggccgcgctgggcgaccacagcgatccggtgctgctcgcccagctcgccggggtcgatgaaatcggtttcgccggtgcccgccgcgcgctggtggacgccggcctgttggcccggggacgggacgtccgcttcgtccacggcgtcgtccgcgatgcggtggactccctgctcaccctcgacgagcgggaacgctcgcacgacgacgccgccgatctgctgtaccgctgcgggcggccggccgagcaggtcgccggccatctgctggccgtggtccacccgggccggccctggtcggaggcggtcctgcgctccgcggcccacaacgcgctgcgcgccggccggcccgccgacgcggcccggtacctgcgccgcgccctgctgcaccaccgcacccaggacggctgccgcgcccgcatcctggtcgatctggccaccgccgagcgcgccctcgaccccgatgcctgtgtacgccacgtcagccaggcggtcgcgctgctggacacctcgcgggatcgggccgccgccgtgttgcgcatcccgccgtccctgctcgccgcccccagcccgtccgccgtcgagttggtgcggcaggccgccgccgggctcgacgaaccggggcagcgggacgaggagggagccgacgaactcgccctgcgcctggaggcgtggctgcggcactccggccacgagaaccccgtcgagctggcgtcctcggtggcgcggctgcggcgcatgggggcacggccgccggtggacagcgtcgccgaacgcgagttggtcgccgtgctgttgagtgcgggcgcgctcagcggccggctcagcgccgcggagatcgccgacaccggcaaccgcatcctcgaacgtgagccggccaccgccgcccatgcccacaccccgctgccgctggtgatgctctcgctgttcgtcgccgagtccgtgcagggcgtggcctcctggctggccagcgaacagcacacccggcgccggtacgcgaccggcgcggacgatgtgctgctgaccgccgagcgggccttcgtcctggtgacgcagggccgcccggccgccgcgcgggagcacgtcgaacgcgccctggtcatggacgccggcgactggtcggaacccgccgtcatgatgttcgccgcggtcgccttcgaactgcgcgacccggccttgagcgaacgcatcctggaacggatccgcgaccgccggccggccggactggcgctcaccgccaccggtcagatgctccaggccgccgtcgacgtgcacttcggccgggggcgggacgccctggacacgctgctggcctgtggccgacgcctggagaccgtgggatggcgcaattccgcactgctgccctggcgtccgtatgcaatcgggctgcaccagcggctcggcgagaccgatgccgcgctgcaactcgccgaggacgagctgaggtgggcccgggagtggggtgcgacgacgaacctgggccgggccctgcgcctgaagggctggctgttgcaggacgagggactggatctgctgcgtgagagcgtcgagatcctccgcgcttcgtcctacgcgacggaactggcgcgcaccctcgtcgtcctcgggcgtcggctgccgggtgggccggaggccgaggcggtgttgcgggaggccgcggggatcgccgccgcctgtggtgttccctggctcgccgaacgggccgaactcggtctgggcagtgccatcgtgccgccggtcgccaccctgacccccagcgagcggcgagtggcgtcgctggtgagccggggcctgaccaaccaggccatcgcgaccgaactcggtgtgagctcccgggcggtggagaagcacctcaccagcgcctatcgcaagctcggcgtctccggccgccgcgagttggtgaatgcgctcccgggtcgttgacgcccgcggccgtcccgttccggacgatcacaatcctctgtgcctgtcagccctgtgggtgcggcgtcgttgtcgtacgcccgtccggtcatgacagcaatcctcaacaaaagctcaaacggaagcgggggcaggtgcatccaccccatcaccaatgtctcgtatgttacttttggcccaccgtagttgggactctgcggaccgtacctcgtcaagtacggaccacggatttaggggtgcgtagatgtgtcgcgttgacgtgccgagttgtggctaactacgctccgtttcacggaaatcgaaactcttcggcgtgaatcgcggcgaacttcgatcgaattctggattccgtttctcagaaggctaaaagacgacgggggttatccgaaaggatggcggtctcgtgactatcactcacctcactgactcgaatcaccgtacgaccggcggggtgatatccgctcagaccgcaccggccggggagtccgtcggccccgggctgatggcgtccctcgaccgtgacctcaccatcaagcacgccaaccaggagttccgccgccgcttcgacgattccgccggtgacgtctgcggtcgcagcttccgggacctgatgcacccgagcgtgcagcagccgctgatgcgccagttctcccggctgatcgagggcaagcggcaccgcttcgcctcgcacgtggtcgccgtgggcgcccaggacgcggccttcgcgggcaccctcaccgcctccgcggtcaccggcaagaccccggacatcgccgggatcctggtgctcatggactcgtccggcgccgccgacgccgccgatgccggcgtcgtgaccagccagaagaagttcctgaccgagatcgatgcgcgcatcctcgaaggcatcgcggccgggctgtcgaccattccgctcgcctcgcggctctacctcagccgccagggcgtggagtaccacgtcaccgggctgctgcggaagttgcgggtgcccaaccgcgccgcgctcgtctcgcgcgcctactccatgggcatcctgaacgtcggcacctggcccccgaaggtcgtggacgacttcatcaagtgacgcccggccggcctgtcccgcaccggccggccaccgtcggaccgctgtcccgcacgcccgtgtcgccgacgcccgcctctcacggggcgatgcccggcggcacgggcgtttcgtgccctggtcgatgtttatccattctcacgttacgaacccgcaatgctcatgcgcgcgattccggccacttttcgttccgtcgtaaccaaactgcccgtcatatcgtttccactgaccgtttctgtggtccgcggtgtgccacctgggccccactccgacgcgcccgcgacgggtcgcgagcggcctccgaatactcacggtaacccccgttcctcctggtggagttccccgcgcgtcacattcctccgtgcctcgtgcggcgtggctcgcccgctttccccgccgccgcgacagccattgttacaacggcacgacagagcgggggtggtcgacccgtccgcggtgcggcgcagtcaagcggaacctctgctcgatgttcgtgccaccccgaactctgtgttcttggtgaccgttttcaccaatgccccgcccgttcggtggcgaatccgccgcccgttcctggccacaacggatcgcttcggccgcccaccacggccggcgcagccgaggcttgttggaatcacccccacccagtcggggcgccgttgtggcccggacacgcaggaggaacaccgtggatgctgagggccgccgcagggacatgctggagctgatccggcgcagcggatccgccgatgtcgtgcgtctcgccgaggagttcgccgtcagcaaggaaacggtccgccgggacctgaacgtcctggagggccatgggctgatacggcggcggcacggtggcgcctatcccatggtgcggccgggctccgaggccgtcttcgtctcccggaccgcacagccgatcccggaggagtcccggatcgccaccgcggccgccgaactcctcagcgaggccgagacggtcttcatcgacgagggcttcaccccgcaactcatcgccgacgccctgccgcgcgaccggccgctgaccatcgtcaccgcctcgctcccggtggtcagcgccttcgcgacgagcccacaggccaacgtgctgctcctgggcggccgggtccgccggggcacgacggccaccgtcgaccactgggccgtccacatgctgtccggcttcgtcatcgacctggccttcctcggcgcggaggggatctcgcgcaggtacggcctgaccacccccgacccggcggtcgccgaggtcaaggcccaggccatccgcgtcgcgcgccgcccggtcctcgccggggtgcacaccaagttcggcacggcgagcttctgccggttcggagaggtgggcgacctggagacgatcgtcaccggcgccggcctgcccgtcgccgaggcccaccgctaccacctcatgggccccaaggttttacgggtgtgacgccgccggggcgtcccgccgcccgcccacggcctggcgcgcgccggtgcgggtcagccgcgtcgcgcgtccgtcggttcccgccagagtgcgagcggtgtcacccccacccggtagccctcctcgtcgaggagatggccgccgtgcttcatgtgccagagggcgaccgcgcgttcggtgacggtcaggtccgcggcccgttcggcgagtcggacctcgaagcgctgggcgtcgtcgagggagcgcacccaggccaccaggtgcaggttgtgccggctgatgacgctcgcgcacaggcggacctcgcgcatcccggtgacccggcgggtcacctcgcgcagcctcgcggccgggacctgcccccagaagctcaccgtgaccggccactcggacagcgggcgggcgacctcgcaccgggcgtgcaacatgtccgcggcgaagagccgttggacgcgacggcgcacggtgtcggggccggcgccgcactgctcggccagcgcgcggtaggtggcccggccgtccacggacagcgcggtgaccagctgttggtcgagctcgtcgaggacgaaggcgggggtgtccgtgcggtgtctggacgcgtcggcggcgagccgggcgacctggtgccggccgagggcccgcaggcgccaccggctgccctcggtgtgcaccgggccggccaggtgcgtccgggcggcccggacgccgtccaacgcggcgaggtcgtgggtcacccaacgggagagcatggccggatcgcgggccatgacgttgagttggaggtcacggtccccggtgacgtgggagagcgccaccacgtgcggcgcggcggccaacgcccgcgcgacgtcgagcagtcggccgggagcgcagtcgatctcgacgaacgccaggcacccctggcccgacgcggccagcaccggggccggatggcagctgatccaggcggcgccggtctcgaccagccggttccagcgcctggccaccgtcacggcgtccagtccgaggacggagccgatccgggtccagctggcccgcggcgtgatctgcagcgcgtgcaccagggcctgatccacatggtccagggaccggggggtctgcccggaatcctgcgccacgggccacctccttgcgtgtttccggcggattcgggccgccggtcggctcaaccttcagcctggactcgggtacggccggaccgtaccaggcaacccccggagcaacaggagtgggattcggcatgtcggcagtggaacgcgccaaggaaatgcaacccgagttggagcggctgcgccggtcgctgcaccgggagccggagttgggccttgcgctgccgcgcacccaggagaaggtgctcgcggcgctcgacgggctgccgttggagatcaccccgggcaccggcctcacctcggtgaccgccgtcctgcgcggcggccgccccggcggcgcagtgctgctgcgcggcgacatggacgcgctgccggtcaccgaggagagcggtgtgccgtacgcctcggagatccccggccggatgcacgcctgcggacacgacctgcacaccgccggactcgtcggcgcggccaggctgttggccgaacgccgggaacgcctgcacggcgacgtggtgttcatgttccagcccggcgaggagggccacaacggggccggcgcgatgatcgaggagggcgtgctggacgcggcgggcaagccgctcgacgcggcgtacgccctgcacgtggcgtccaaccaggtgcccggcggcgtggtcatcacccgctccggcaccatcacctcggcctccgacctgctgacggtgacggtgcggggcgagggcggccacggctcgacgcccgccacggccaaggacccggtcccggcggcctgcgagatggtcaccgcggtgcagaactgggtgacccgcgccttcgacatcttcgacccggtcgtggtcaccgtcggcaccttccacgccgggacgaaggcgagtgtcatccccgacaaccgccgagttccaggccacggtgcgcagttattccgaatccgcccgggaccggctcgccgaagggaactgccccgtctggtgcgggccatcgcggccgcccacggcctggaagcggaggtcgactacctccggcactatccggtcaccgtcaacgacacggacgagaccgccttcgcggtggccaccgcccgcgacctgttcgcgcccggcgaggtgtgggagtcgccgatacccaccaacggctccgaggacttcgcgtacgtcctccggcgcgtccccggcgcgatgctgctggtgggcgccgcccccgaggggagcgactggcagcacgcgccgatgaaccactcgccgcgcgccgtcttcgacgaccgggtgctgtaccggcaggcggcgctgctgaccgaactcgccgcgcgccggctcgcggccaccgcgccggccgagcccgccgtggcgggatgacaccgccgccgcacgcgtggggcccgcacgcgtgcggcgtacgggccctggccggtctccttcccggctacttgcgcgcggggcactccttccacgcgaagtggtagagggtgttgatgctgccgtcggtggagtcatggccatgtagctggtggccttggggtcagccccgctgccgt

SEQ ID NO: 2 - DNA, 27541 bp, Streptomyces noursei
gaattcggatcgatgctgctcgtggtgtgtgccgcgggaggtgccgacggtgccgtgcgtgaatcggggcgtggtcgccgtcgcgatcgcggtggtgtcggtgctgctcgtgctgaccgtggtggtggcgacggcctacttgccgtgagcccggtccttgcgccgcgacctgggcagcggatgcacctcttcggtcgacgccaaggggcggtggcgcaggtcgagataggcgcggacggagacgccgggctgccccggcgtctgccagggcgcggaggggccgctggaacgccacagacggcccagctcggccgcggcaagggtggcggtggcttcgtcggcggcggtgacgtcgatgacgaccatgccgggttcgctgacatgttcctcgtggatatgcacagttctgtatgacctatttcgccccgtggcgtaaggagtagccggcaggtttcatccgaaggtggggcgcgggagcggcgagttgaccgtgaggtgcgtgcggtgttcccggtcgcgccggggggtgggggccggcaggtggaccgccgtggtcagcagggcgggggtgctgtgccagcggccggggaagaccgtgacccggcgaccgcccagcagggggcccgggaccaggagtcgggcggtgaaggcgccctgtgtcgggtcgatgacgatctcggcctcggagaagtccagttcgcgctgggtcaggggataccacgccttgaagacgctctccttggcgctgaagagcagccggtcccagtggacgtccggacgatgggccgccagggccacgaggtgcggccgttccgagggcagggcgatggcgttcaggacgccggccggcagcggaccgttcggttcggcgtcgatgctcaccgcggccgacagctccgcgggggagacggcggcggcgcggtagccggcgcagtgcgtcatgctgccgacgatgcccggcggccactgcggggcgccgcgccgattgggcagtatggcccggtccgggtggccgagccggcgcagggcccggcgggcgagatggcggacggtggtgaactcgcgctgccgggactccacggcccgggcgatgacctcgcgttccgaggagagcagccggtcgccggggcgcggccggtcgtcgtacgccgcctcggtggcgaccgtggcgggcaggatcagttcgatcaccgcatacctccggcgaacggtaagaacagggggttgcttcggggcacggttccgtccttgacggggcgccgtgggcggccgggtcagccggccgcggcgcccgcggtgggagtgtgggtgcgggctgcgtgcagccgggcgtacaggccctgcgcgcacaggagttgatcgtgggtgccctgctcgacgatgcggccggcgtccatcacgacgatcaggtccgcgtcgcggatcgtggacaggcggtgcgcgatcacgaagctggtccggcccgcccgcagggagttcatggcgcgttggatcaggacctcggtccgggtgtccacggagctggtggcctcgtccagcacgaggacggccggtctggcgaggaaggcccgggccacggtcagcagctgcttctcgccggcgctgacggtgcccgactcgtcgtccagcacggtgtcgtagccctgcggcagggtgcggatgaagcggtcggcacaggtcgcgcgggccgcctcctcgatgtccgcacggcaggcaccgggtgcgccgtacgcgatgttctccgcgatggtgccgccgaacagccaggtgtcctggagcaccagcccgaagcgggaccgcaggtcgtcgcgggtcatcgtcgcggtgtcggtgccgtccaggaggatgcggccggagtccggttcgtagaagcgcatcaggaggttgccgagggtggttttgccggcgccggtggggccgacgatcgccacggtgctgcccggttccacggtcagcgagaggttctcgatgaggggcgtgtcgggggagtagcggaaggacacgtcggtgaactcgacgcggccctcggcgcgggcgggcgtgccgggccggagcgggtccggggcctgctcgggggcgtcgagcagggtgaagacgcgctgggcggaggcgatgccggactggagccggcccgccaccgaggcgatctccacgatcggctggctgaactggcgggcgtagaggatgaacgcctgcacgtcaccgagggtcagggtgccgtttatgaccttccaggcgccgatgacggccaccagcacatagccgaggttggcgacgaacatcatgaccggttccatggcaccggaggcgaactgcgccttggccgcagcccggtagaccgcgtcgttgcaggcgtcgaagcgctcctcggccgccgcgcgccggtcgaagcccttgatcagcgcatgaccggtgcacacctcctccacatgggcgttgagggtgccgttcgcggaccactgcgcggcgtagtggggctgcgcgcgcttgctgatccgggccgcgatcaacgccgagaccggcacgctgagcagcatcaccacggccagcgacggcgagatcaccagcatcagcaccagcatcgtcaacagcgagaagatcgaggtgatcagctcggcgagggtctgctggagggtctgttggaggttgtcgatgtcgttggtggtgcggctgagcagctcaccggccggctgccggtcgaagtggcgcagcggcagccgggtcagcttctcccgggcgtcgcggcgcagttcgtggatggtgcgccacaccgcggacgccaccagccggccctgcgccagcatgaacagcgacgccacgacgtagagcgccagcaggaccagcagcagccggccgatcgcggcgaagtcgatcccgggcgccgggcccgggacgccgccgagcacgccgtcggcgatcagatcggtgacccggccgagcagcagcgggccgaacgcgttgagcacgatcccgccgacgcccatcgacacggcgagtgccacggagcggcggtgcggacgcagcaggccgacgagccgacgtgccggccggggcgcggtccgctcctcctcaaggtcgtccggcgaggccatgggcggcttcctcctcggtcagctgcgagagcgcgatctcgcggtaggtcgggctggtgcgcagcagcacgtcgtgggtgccctgggcgaccacgcgcccgcggtccagcaccacgatccggtccgcgtcgcggccggcggagatccgctgcgccacggtgatcaccgtggcgcccgcggtgtacggcaccagcgcggtccgcagcgccgcatcggtggcctggtcgagcgccgagaaacagtcgtcgaagagatagatctccggccggcgcagcaacgcccgggcgagggacaggcgttggcgctggccgccggagacattgccgccgccctgggtgatctccgcgtcgaggccgtccggcatccgcgccacgaagtcggccgcctgggcgacccgcagcgcctcccacagctcctcgtcggtggcgtccggccgcccgaagcgcagattgctcgccacggtgccggagaacaggtacggccgctgcggcacgaacccgacggcggcggcgagcgtggccgcggtcagctcgcggacgtcggtgccgccgacccgcaccgcgccctcggtggcgtcggccagccgcagcaccaagttcaacagggtcgtcttgccgctgccggtgctgccgagcacggcgatccgctcgcccggctcgacggtcaggtcgacgtcccgcagcacgggctcctcggcgcccgggtagcggtacccggccgcgcacagttcgatccggccggcgggcccgcgcaccggctgcggcgcggccggcggcgccacgctcgacccggtgtccaggacctccgcgatccggccggcacagacccgggcccgcggcaccgacaggaacacgaaggcgagcatcacgacggacatcaggatcagcgagagatagctcaggagggcgctgagcgagccgatcggcatccggcccgcgtcgatccggtgggagccggtccacagcagggctacggtgaaaccgttcatcagcagcagcacgaccggcagcatcgtcgcgatcagccgacccacccgccgcgacaccacgaggaacgcgtcgttggtctgcgcgaaccgcgcgcgctcgtggtcgtcgcggacgaaggaccggaccacccgcaccccggtgatcgcctcgcgcagcagccgccccagccggtccagggtcagctgcatccgcgcgtacagggtgcccatccgggccagcagcaggccgaagcagaccgccaccaccagcaccagcgccaccagcagcagtgccagcggaacgtcctggcgcagcgccagcagcacgctgcccaggcacatcagcggcgcgcagacgacgatgccgaagccggtctgggcgaggttctgcacctgctgcacgtcgttcaccgaccgggtcagcagggagggggtgccgaaccggccgatctcgcgggcggagaagtccaggatgcggcggaagagcgcggaccgcagatcgcggcccatcgccgtcgcggtccgggcggccagcgcggccgcaccgagcgcggcggcgatctgcaccagcgccaccacgcccatcaccacacccagctcggtgatgcgcccgccgtcgccgcgcaccaccccctggtcgataagtgcggcgcccagcgtcggcagcagcaaagtgcccaggatctggacgagttgaagggcgacgagagcggcggtggcccaggcgtaggggcgcagctgtgcccgcagaagtctcaacagcacggaggaacaccccggttgacggcggcgtgcggccgcgcggtggacggagtcggccggcccgccgacccggtcattgcaccgcagtccgctccgaaatttcactagtgttgggggtggcaacggacttttgacggcccggtactcgtgaattccctagaaagcccgggatgcgttgacagcatcttccgcggcttgcgagcgtgcgggtgtctatcgtccggactgcgtattcgacgccaggtcgtggccgagctcaagcgtttggacggtctctttcgtgttcgagaagggtttgccatgtccaaacgagcgctgatcaccggaatcaccggccaggacggctcctatctcgcggagcacctgctgtcccagggctaccaggtgtggggtctgatccgcggccaggccaatccccgcaagtcccgggtcagccgcctcgcctccgaactcgacttcatcgacggggacctgatggaccagggcagcctggtctccgccgtcgacaccgtgcagcccgacgaggtctacaacctcggcgccatctcgttcgtgccgatgtcctggcagcaggccgagctggtcaccgaggtcaacggcatgggcgtgctgcgcatgctggaagccatccgcatggtcagcggactgtccacctcccgcacggtcagcccgcgcggccagatccgcttctaccaggcgtccagctcggagatgttcggcaaggccgccgagacgccgcagcgcgagaccaccctcttccacccgcgcagcccctacggcgcggcaaaggcgtacgggcactacatcacccgcaactaccgcgagtccttcggcatgtacgcggtctccggcatgctcttcaaccacgaatccccgcgccgcggccaggaattcgtcacccgcaagatcagcctggcggtcgcccgcatcaagcaaggcctccaggacaagctggcactcggcaacctcgacgcggtgcgcgactggggctatgccggcgactacgtccgcgccatgcacctgatgctccagcaggacgccggcgacgactacgtcatcggcaccgggcagatgcactcggtgcgcgacgcggttcggatcgcgttcgaacacgtcggcctgaactgggaggactacgtcgtcatcgaccccgacctggtgcggcccgccgaggtcgaggtgctgtgcgccgacagcgccaaggcccaggaccgcctcggctggaagccggacgtcgacttccccaccctcatgcgcatgatggtcgattccgacctggcgcaggtttcccgcgaaaaccaatacggcgacgtgctgctcgccgccaactggtagcagttctcaagctttcgaaaactagtgaattcctgccggaattccgacgacactcgccacatggattcccccggtgagtggcgaatccaggtggcgaatccgaacgtaccgccgaaacggcgtggagaagtcggacgccattcacgtgcggccgtcggctgtcgagatgggttgagttgagatggacaacgaacaaaaactccgggattacctcaagcttgcgacggccgaccttcgacgcacccggcggcgcgtccacaagctggagtcggcggcccaggaaccggtggccatcatcggcatgacctgtcgctaccccggcggcgtccgcagccccgaagacctctggcgcatggtcgaggccggcgagcacggcgtcaccccgttccccaccgaccgcggttgggacctggaggcgctggccgccgcgccgaccgcctccggcggattcctgcacgacgcacccgacttcgacgcggacttcttcggcatctcgccgcgcgaggcggtcgccatggacccgcaacagcgcgtcgtcctggaatccgcctgggaggcgttcgaacgcgccggcatcgacccgacgtccgtgaagggcagccgcaccggagtcttcatcggcgcgatggcccaggactaccgggtcggccccgccgacggcgccgagggcttccaactcaccggcaacaccggcagcgtgctgtccggccgcatctcctacaccttcggcacggtcggccccgccgtcaccgtcgacaccgcctgctcctcctccctcgtcgccgtccacctcgccacccaggcgctgcgggccggcgagtgcaccctcgccctcgccggcggcgtcaccatcatgtccggccccggcaccttcatcgaaatgggccgccagggcgggctctccgccgacggccgctgccgctccttcggcgacaccgccgacggcaccggctgggccgaaggcgtcggcatcctcgtcctggaacggctgtccgacgccgtccgcaacggccacgagatcctcgccgtcgtccgcggcaccgccgtcaaccaggacggcgcctccaacggcctgaccgcccccaacggcccctcccagcagcaggtcatccagcaggccctggtcaacgcccgactcgccgccggggacatcgacgtcgtcgaggcgcacggcaccggcaccaccctcggcgaccccgtcgaggcccaggccctgctcgccacctacgggcagaaccgcccggcggaccggccgctgctgctgggctcggtcaagtccaacctcagccacacccaggccgccgccggcgtcgccggcgtgatcaagatggtcatggcgatgcggcacggcaccctgccgcgcaccctgcacgccgaggagcccacccaccacgtcgactggtcgcagggcgccgtgcggctgctgaccgacaccaccgactggcccgccaccggggcgccgcgccgcgccgccgtctcctccttcggcatcagcggcaccaacgcccacaccatcatcgagcaggcccccgaaccgcagcccgaggacgccgcgaccgcgcaggacgacgccgccggcagcacgccggccaccgcccccgtagtgcccggcgtcgtaccggtcctgctctccggccgcaccccggacgccctgcgcggccaggccgcggccctgcgcgccgccctcgacaccggccggcggcccgacctgctcgacctcgcacactccctcgccaccacccgcgccgggttcgagcaccgcgccgtcctcctcgccaccgaccaccccgccctgaccgacggcctcaccgccctcgccgacgccgacgacccggccgccgcccccgcctggatcaccggcaccacccgggccgagacccggctcgccgtcctgttcaccggccagggcgcccaacgcctcggcgcgggacgggaactcgccgcccgtttcccggcgttcgccaccgccctcgacgcggcgctcgacgccttcaccccgcacctcgaccgccccctgcgcgaggtcctgtggggcaccgacgccgccctgctcgaccgcaccgcatacgcccagccggccctcttcgccgtcgaagtggcgctctaccggctgatcgaatcgttcggcgtccgccccgaccacctcgccggccactccgtcggcgagatcgtcgccgcgcacctcgccggggtcctctccctggccgacgccgccaccctcgtcgccgcccgcggtcgcctgatgcaggcgctgcccgacggcggggcgatgatcgccgtccaggcgtcggaagccgacgtcgccccgctgctcgccgggcacgaggaccaggtcgcgatcgccgccgtcaacggcccctccgccgtcgtcctgtccggcgccgaagccaccgtcaccgcgctcgccgaacagctcgccgccgacggccgcaagacccgccggctgcgcgtctcgcacgccttccactcgccgctcatggagccgatgctcgacgccttccgcgccgtcgtcgaagacctcacgctccagccgccgctcctgccggtcgtctccaacctgaccggcaagcccgccaccgtcgcccaactcacctccgccgactactgggtcgaccacgtccggcacgccgtccgcttcgccgacggcatcgactggctcgcccggcacgacaccaccgccttcctcgaactcggccccgacggcgtgctgtccgccatggcccaggactgcctggacgccgccgacgcagacgccgtcaccctccccgccctgcgcgccgggcgccccgaggagcacaccctcaccaccgccctcgccggtctgcacgtccacggcgccaccctggactggaccggctgcttcgccggcaccggcgcccgccgcaccgacctgccgacctacgccttccagcgccgccgctactggcccaaggccctccagagcggcaccgccgacctgcgctcggtcggcctcggtgccgcccaccacccgctgctctccgccgccgtctccctcgccgacgcaggcggcaccctgctcaccggccgcctctcccggcagacccacccctggctcgccgaccacaccgtccgcggcaccaccctgctgcccggtaccgccttcctcgaactcgccgtccgcgccggcgacgaggtcggctgcgaccgcgtcgaggaactcaccctcgccgcaccgctcctgctgcccgaacagggcggcgtccaggtccagttgtggatcggcaaccccgacgtgtccggtcgccgcaccgtcaacgtccacgcccgccccgacaccggcgacgacaccccctggaccgcccacgccaccggcgtcctcaccaccgccgacgcctcccgccagctcccggcttcgtccgagcagggcggcacccccctcgccggcgacccccaccccgccctcgacgcggcccagtggcccccggccggcgccgaaccgctgccgctggacggccactacgaccgcctcgccgacggcggcttcggctacggcccggtcttccagggcctgcgcgccgcctggcgcggcggcgacgtcgtctacgccgaggtcgagctgcccgaggccggccggtccgacgccgaggcgttcggcctccaccccgccctgctcgacgccgccctgcacgccgcgcccttcaccggcctcggcgaacgcggccggggcggcctgccgttctcctgggagggcgtctccctccacgccggcggcgccaccaccctccgcgtccgcctgaccccggtcgccgacgacgcgctcgccctgaccgtcgccgacggcaccggcgcgcccgtgctgtccgtcgactcgctcgtcctgcgcagcgtggcgacccaacagctcgacacggccgccgccgtcgcccgtgacgccctcttccgcctcgactggacccccgtccagccgaccgccaccgaccccgggcccgtcgccctcctcggcgccgaccccttcggcctgctcacccacgccggattcgccgacgccccggcatacccggacctcgccgccctcgccgcggcggacggcccggtcccgaccaccgtcgtgctgtccctcgccggcaccggggacgacgcggccgacccggcccggtccgcacaccgctgcgccgcggaggccctcgccgccgtacagacctggctcgaccaccatgagcgcttcgccgccgcccgcctggtcttcgtgacccgtggtgcgacggtcgggcgtgatgttgctgctgctgcggtgtggggtctggtgcgttcggcgcagtcggagaatccggggtgttttgctctggtcgatctggatccggatggtgcggtgggtgcggctgcgctcgtcgctgcgttggtcagtggtgagccgcagcttgcggtgcgcggtgatgtgttgcgggtcgcgcgtctggtgcggcggccgctcaccgaggtcggtgcgggtgctgatggcaccggggatggcgtcggggatggctctggtgtgtcgttctcgggtgagggtgcggtcctggtcactggtggtacgggtggtctgggtgcggtgttggcgcgtcatctggtggccgagtatggggtgcgggatctgctgttggtcagtcgcagtggtgaacgtgccgtgggtgctggggagttggtggcggagcttgcgggtgtgggtgcgcgggtgcgggtggttgcgtgtgatgtgaccgatcgtgccgcggtggtggagttggttggcgggcatgcggtgtccgcggtggttcatgcggctggtgtgctggatgacggcatggtgggtgcgttgaccggggagcggttgtccgcggtgctgcggccgaaggtggatgctgtctggcatctacatgaggcgacccgcggcctggacctggacgcgttcgtcgtcttctcctccctcgccggggtcttcggcagtcccggccaggccaactacgcggccgcgaacgccttcctggacgcgctgatgacgcggcgccgggcggagggactgcccggcctgtcactcgcatggggaccgtgggagcagtcgggcggaatgacgggcaccctgacggacgtcgacgccgaacggctggcccgctccggtgtcccgccgctctccgtggcgcagggcctggccctcttcgacgctgccgtggccgggaccgacgccacctgcgttccggtccgcctggacctccccgtcctccgcgcacggggtgaagtgccgccgctgctgaggtcgttgatccgcgtccgggcgcgccgagccgccgtcgccggctccgccaccgcgggcaacctcgcccagcgcctgcgccgcctggacgaggacggccgcgacgagatggtcctggacctcgtccgcggtcaggtcgccctcgtcctcggccacgcgaccggtggcgacgtcgacgccggccgtgccttccgcgacctcggcttcgactcgctgaccgccgtcgaactgcgcaaccgcctcaacaccgtcaccggcctgcgcctgcccgccaccctggtcttcgactacccgaccgtccggcacctcgccacgtacgtcctggacgagttgttgggcacggatgccgaggtggcgaccgtgcagccggccgcggttgcggtggcggacgatccgatcgtcatcgtgggcatggcctgccgctaccccggtggcgtcagctcccccgaggacctgtggcgcgtgctcaccgaaggcaccgacgccgtctcgggcttcccgaccaaccgtggttgggacgtcgaatccctctatcacccggaccctgaccacccgggtacctcctacacgcgctcgggtgggttcctgcatgaggcgggggagttcgatccggggttcttcgggatgagtccgcgggaggcgttggcgaccgattcccagcagcggttgttgttggagtcgtcgtgggaggcgatcgagcgggccggtattgatccggtgagtttgcggggtagtcggacgggtgtgttcgcgggggtgatgtacagcgattacagcgcgatgttggcgagtccggagttcgagggtttccagggcagtgggagttcgccgagtttggcgtcgggtcgggtggcctacacgttggggttggaaggcccggcggtgacggtggatacggcgtgttcgtcgtcgttggtggcgatgcactgggcgatgcaggcgttgcgtagtggtgagtgtgggttggcgttggccggtggtgtgacggtgatgtcgacgcctgcggtgtttgtggactttgctcggcagcggggtttgtcgccggatggccggtgcaaggcgtttgcggatgcggccgatggtgtgggctggtccgagggcgtcggcgtgttggtcctggagcggcagtcggacgcggtgcgcaatggtcacgagattttggctgtggtgcggggttcggcggtcaaccaggatggtgcgtccaatggtttgacggcgcccaatggtccgtcgcagcagcgggtgatccggcaggcgttggccagtggtggtctgacggccggtgacgtggatgtggtggaggcgcatggtacgggtacgacgctcggtgatccgatcgaggcgcaggcgttgttggcgacgtatgggcgggatcgtgagcctgagcggccgttgttgttgggttcggtgaagtcgaatctggggcatacgcaggctgctgcgggtgtggcgggcgttatcaagatggtgttggcgatgcggcatggtgtggtgccgcggacgttgcatgtggatgcgccttcttcgcatgtggactggtccgagggtgcggtggagctgctcagtgagcaggcggcctggccggagacgggtcgggtgcggcgggcgggtgtctcctccttcggcatcagcggtaccaatgtgcatgtcatcgtcgagcaggcgccgggcgccaaggcgatcgccgcggccggtgcggcgcggcgcacgccgggtgccgtgccggtgctgctctcggggcgtggccggagtgccctgcggggccaggccgcccgcctgctcggacacctccaggcccgacccgacgccgaactcgtcgatgtcgcactgtcgttggcgaccacccggtcccgcttcgagcagcgggccgccgtcgtggcgcaggaccgcgaccagctgatcgcctcgctgggggcgctggccgccgaccgccccgaccccgccgtcgtcgagggcgaggccgccggacgcggccggaccgcggtgctgttcaccggacagggcagccagcgggccgccatggggcgtgaactccacgaggtgcagccggagttcgccgcggcgttcgacgcggtgtgtgccgttttcgacccgctgttggaccggccgctgcgcgaggtggtgttcgccgaggacggcagcgacgaggccgcactgctggacgagaccggttggacgcagccggctctgttcgccgtcgaggtggcgctgttccggctggtggagagttggggtgtccgtccggacttcgtggccggccattccatcggtgagatcgcggcggcgcacgtcgccggggtgctgacgttggaggacgcctgccgtctggtggccgcgcgggcgacgctgatgcaggcgctgccgaccggcggcgcgatgatcgcgatccaggccaccgaggacgagatcgcggcgcacctcgacgacacggtggcgatcgccgccgtcaacgggccgcagtccgtggtgatctccggtgacgaggaggccgccgaaacgatcgccgccacgttcgccgaacgcgggcgcaagaccaagcggctgcgggtgagccatgccttccactcgccgcggatggacgggatgctggacgccttccggatcgtcgccgaggggctgacctaccgggcgccgcgcatcccgctcgtctccgacctcaccggccggcgcgccgacgatgcggaggtgtgcaccgcggagtactgggtgcggcacgtccgagaggccgtgcggttcgccgactgcgtgcggacgctgcgcgacgccggggccaccaccttcctggaactgggctccgacggcctgctgaccgcgatggccgaggacaccctcggtgacgaccacgacgccgaactggtgccgatgctgcgcgccgggcgcgccgaggaactggccgcggccaccgccctggcccgcctccaggtgcgcggcgtggacgtggactgggcggcgtacctcgccggcaccggcgcccgacgcaccgacctgccgacctacgccttccagcacgcgtactactggccgcagctgccgaccccggccgccgccctcgccgccgccgatcccgccgaccagcagctgtgggccgctgtggagcgcggcgacgcccgcgaactcgccgacatcctcggcctgggcgaacaggacctcacgccgctggactccctgctgcccgccctcacctcgtggcggcgcggcaaccaggagaagcacctcctggacaccctgcgctaccgcgtggagtggacacgactgagcaagccgaccgccccggtcctcgacggcacctggctgctggtcgcctccgacgccaccgcggccgaccagccagccctcctcgacggcctggccgacgccctcggctcgcacggcgcgcgggtgcgtcgcctgcttctggacgactcctgcgcggaccgcgcggtgctcgccgaacgactggcgcggaccgccgacgtggacgccgcgacccaggtgctgtccgtgctgccgctcgacgagcgggacgccgacgactgcccgccgctcacccgcggactggcgctgaccgtcgcgctcgtccaggccctcgccgacaccggcgcccagggccggctgtggaccgccacccgcggcgccgtctccaccaaccccgccgacccggtcacccaccccgtccaggccgctgcctggggcctgggccggggcgtcgccctggagcacccacggctgtggggcggcctggtcgacctgccgcaggtcttcgacgagcgggccggacagcggctcgccgggatcctcgccgtcaaggacgcaccggacggcgaggaccaggtggcgctgcgggccaccggagtctccggccgccggctcgtccgccacaccgtcgaagcgctgcccacggccgcggagttcaccgccaccggcactgtcctgatcactggtggcaccggtggcctgggcgccgaggtcgcccggtggctggcccgcgccggcgcccagcacctcgtcctgaccagccgccgcggcccggacgcgccgggcgccgccgaactccgggccgaactggagggctacgggccgtcggtgtccgtcgtcgcctgcgacgtcgccgaccgggacgcgctcgccgccgtcctcaccgcactgcccgaggaactgccgctgaccggtgtcgtgcacaccgcaggcgtcggccactacggcccgctggacaccctgagcaccgccgagttcgccggcctcaccgccgccaagctcgccggcgccgcccacctcgacgccctgctcgccgaccgcgaactggacttcttcgtcctcttcggctccatcgccggtgtctggggcagtggcaaccagagcgcctacggcgccgccaacgcctacctcgacgcgctcgccctgcaccgccgcgcccgcggcctcgccgcgacctccgtcgcctggggcccgtgggccgaggccggcatggccgccgacgatgccgtttccgagaccctgcgccgccagggcctcggcctgctcgacccggccccggccatgaccgagctgcgccgcgccgtcgtccggcaggacgtcaccgtcaccgtcgccgacgtggactggcagcgctacgcaccgctgttcacctccgcccggcccagcgccctgatcgccggcctgcccgaggtccgcgccctcgccgccgacgagcgcaccgagcaggacgccaccggcgcctccgaggtcgtcacccgcgtccgcgccctggccgaacccgagcaactgcgcctgctgaccgacctcgtccgcaccgagtccgccaccgtcctcggccacagctccgccgacgccgtgcccgagggccgcgccttccgcgacgtcggcttcgactcgctgaccgcggtcgagctccgcaagcgcctgggcgccgcgaccgggctgtccctgcccagcaccatggtcttcgactacccgacaccgctggaactcgcccagtacctgcgggcggagatcctcggcgcggtgctggaagtcgccggcccggtcgccaccggcggcgccgacgacgagccgatcgccatcatcggcatggcctgccgcttccccggcggcgtcagctccccggaacagctgtgggacctggtcgcctccggcaccgacgcgatcagcgagttccccgtcaaccgcggctggcagaccgggcacctcttcgacccggaccccgaccggcccggcaccacctactccacccagggcggcttcctccacgaggccgacgagttcgaccccaccttcttcggcatctcgccccgcgaggcgctggtcatggacccgcagcagcggctcctgctggagaccacctgggagtccttcgagcgcgccgggatccgcccggaaaccctccgatccaccctgaccggcaccttcgtcggctccagctaccaggagtacggcctgggcgcgggcgacggcaccgagggccacatggtcaccggcagcagccccagtgtgctctccggccgactgtcgtacgtcttcggtctggaaggcccggcggtcaccgtcgacaccgcctgctcgtcctcgctcgtggcgctgcacctggcctgccagtcgctgcgcaacggcgagagcaacctggccgtcgccggcggcgccacgatcatgacgacgcccaacccgttcatcgcgttcagccggcagcgcgccctcgccaaggacggccgctgcaaggcgttctccgacgacgcggacggcatgacgctcgccgagggcgtcggcgtcgtcctcgtcgagcggctctccgacgcgcagcgcaacggccacccggtcctggccgtcctccgcggctccgccatcaaccaggacggcgcctccaacggcctgaccgcgcccaacggcccgtcccagcagagggtcatccgccaggccctcgccaacgcccgcctcgcgcccggggacatcgacgccctggaggcgcacggcaccggcacaccgctcggcgaccccatcgaggcccaggcactgttcgccacctacggccgcgaccgcgaccccgagagcgcgctgctgctcggctcggtgaagtccaacatcggccacacccagtccgccgcgggcatcgccagcgtcatcaagatggtcatggcgctgcgccactccgaactgccgccgaccctgcacgccgacgcgccgtcctcgcacgtggactggtcggccgggacggtccggctgctgacccaggcgcgcgcctggccggagaccggtcgcccgcgccgggccgcggtgtcctcgttcggcatcagcggtaccaacgcccatgtcctgctggagcaggcgcccgtcgcggacaccccggccgaggagcggcccgccgtggcgccggtcccgatcgccgccggcgtcgtcccgtgggtggtcaccgcccgcagcgccgccgccctgcgcggccaggccgagcgcctcctcgcgcacgccgaaaccgtcggaaccgccctgccggccgccggaccgctcgacatcggcctgtcgctggtctccgcgcgcgcccgtttcgagcaccgtgccgtcgtcgtcccgcccgcgggcaccgacccgctggccgcgctgcgcgccgtcgcgacggacgggccctcgcccgtggtcgcccgtggcgtggcggacgtcgagggtcggacggtgttcgtgttccccggtcagggttcgcagtgggtggggatggggtcccaactccttgatgagtcggcggtgttcgcggagcggattgccgagtgtgcggcggcactcgccgagttcaccgactggtcgctggtcgatgtgctgcggggtgtggtgggtgcgccgtcgttggagcgggtcgatgtggtgcagccggcgtcgttcgcggtgatggtgtcgttggctgcgttgtggcgttcccgtggtgtgttgccggatgcggtggtggggcattcgcagggtgagatcgctgctgcggtggtgtcgggtgcgctgtcgttgcgggacggggcgcgggtggtggcgctgcggagtcaggccattggtcgtgcgttggcggggcggggagggatgatgtccgtcgcgctgtcggtggacgtgctcgaaccgcggttggtcgagttcgaggggcgggtgtcggtggccgccgtcaacggcccgcgctccgtcgtggtcgccggcgagcccgaggcgctggacgcgctgcacgcccggctgaccgccgacgacatccgggcccgccggatcgcggtggactacgcctcgcactcgcaccaggtcgaggacctgcacgaggaactgctggaggtgctggcggagctggcgccgcgcacgtcggaggtgccgttcttctcgaccgtgaccggcgactggctggacaccgcgcggatggacgccggctactggttccgcaacctgcgcggacgggtgcggttcgcggacgcggtggcggacctgctggcggcggagtaccgcgcattcgtcgaggtcagctcgcacccggtgctgtcgatggcggtgcaggaggcgatcgacgaggccggcgtgccggccgtcgccgccggcaccctgcgccgcgaccagggcggcaccgaccgcttcctgctgtcggccgccgaggtcttcgtgcgcggtgtggacgtggactgggcggggctgttcgaggggaccggtgcgtcccggatcgacctgcccacctacgccttccaacacgaacacctgtgggccgtcccgcccgccccggaggccgtcgccgccgccgacccggacgacgcggccttctggaccgcggtcgaggacggtgacgtctccgcgctgaccgccgcgctcggcaccgacgaggactccgtcgccgccgtgctgcccgccctgacctcctggcgccgggcccgccgcgaccgctccaccgtggacgcctggcgctaccgcgtcgcctggaaacccctcggcggcaccctgccgcacccgtccctgaccggcacctggctgctggtcaccgccgacggcatcgacgacaccgatgtggcaggggcgttggagacctacggcgccgaggtgcgccggctggtcctggacgaggagtgcgtcgaccgcgccgtcctgcgggagcggctggccggcgcggaggacgtgaccggcatcgtctccgtcctcgccgccgccgagcggaccgacgcggtaccgggcacctccctggtgctcggcaccgccctgaccgtggcactgatccaggccctcggcgacgccgaaatcgacgctcccgtatgggcgttgacccgcggcgcggtctccaccggccgggccgacgagctgaccgcgcccgtccaggcacaggtcaccggcatcggctggaccgcggcgctggagcacccgcagcgctggggcggcaccctcgacctgcccgccgccctcgacgcccgggccgcccagcggctcgccgccgtgctgtccggcgccctcggcagcgacgaccagctggccatccggccctccggggtcttcacccgccgcatcgtgcgggccgaggccaccgccgggcggcccgccggcacctggacgccgcgcggcaccacactggtcaccggcggctccggcaccctcgccccgcacctcgcccgctggctggcccaacgcggcgccgagcacctggtcctgatcagccggcgcggcacggccgccccgggcgccgccgaactcgtcgcggaactggccgagtcgggcaccgaggcgaccgtcgccgcctgcgacatcaccgaccgcgacgcggtcgccgcgctgctggccgacctcaaggccgacgggcgcaccgtccgcaccgtcgtgcacaccgccgccaccatcgagctgcacaccctggacgccaccaccctggcggacttcgaccgggtgctgcacgccaaggtcaccggcgcccaggtcctcgccgaactgctcgacgacgaagagctggacgacttcgtcctgtactcctccaccgccggcatgtggggcagcggcgcccacgccgcctacgtcgccggcaacgcctacctcgccgcgctcgccgagcaccgccgggccaacggactgcccgccctgtcgctgtcctggggcatctgggccgacgacctcaaactgggccgggtcgatccccagatgatccggcgcagcggcctggagttcatggacccgcagctggccctgagcggcctgcagcgggcgctggacgacaacgagaacgtgctcgcggtcgccgacgtggactgggagacctaccaccccgtctacacctccggccgacccaccccgctcttcgacgaggtgccggaggtccgccggctcaccgcggccgccgagcagagcgccgggaccgtcgccgagggcgagttcgccgccgcgctgcgcgccctgtccgacgccgagcagcagcgcaccctgctggagaccgtccgcaccgaggcggcgtccgtcctcgggctgtcctccgccgaggacctcaccgaccagcgggccttccgcgacgtcggcttcgactcgctgaccgccgtcggcctgcgcaaccggctcgcctccgtcaccggcctgacgctgccctcgacgatggtcttcgactaccccaacccggccgcgctcgccgcctatctgcacggcgagctggccggcgcccggtccgccgccgccggcgccgccgccgtcccgaccggcgcccccgacgccgacgacccgatcgcgatcgtcggcatgagctgccgctaccccggcggggtcggctccgccgaggacctgtggcggatcgccctggacgaggtcgacgcgatctccggcttccccgccgaccgcggctgggacgccgagggcctctacgacccggaccccgaccggcccggccgcacctactccgtccagggcggattcctgcgcgacgtcgccgagttcgacccgggcttcttcgggatctcgccgcgcgaggcgctgtcgatggacccgcagcagcggctcctgctggagaccgcctgggaggcgttcgagcacgccggcatcgacccggtcggccagcgcggcagccgcaccggcaccttcgtcggcgccagctaccaggactacgcctccggcgtgcccaacagcgagggctccgaaggccacatgatcaccggcacgctctccagtgtgctgtccggccgggtgtcctacctcttcggcttcgagggccccgccgtcacgctcgacaccgcctgctcctcctccctggtcgccatgcacctggcctgccagtccctgcgcaacggggagagctcgctggccctggccggcggcgtcagcatcatgtccaccccgatgtcgttcgtcggcttcagccggcagcgcgccctcgccgaggacggccgctgcaaggcgtacgcggacggcgccgacgggatgaccctcgccgagggcgtcggcctggtgctgctggagcggctgtccgacgcccgcgccaacgggcaccaggtgctcgccgtgatccgcggctccgccgtcaaccaggacggcgcctccaacggcctgaccgcacccaacggcccgtcccagcagcgcgtcatccgccaggcgctggccaactccgcggtggcgcccggcgacatcgacgtcctggagggccacggcaccggtaccgccctcggcgaccccatcgaggcgcaggccctgctcgccacctacggccaggaccgcgcccccgaacggccgctgctgctcggctcggtgaagtccaacatcggccacacccagatggcatccggcgtcgccagcgtcatcaagctcgtccgcgccctccaggaaggcgtggtgcccaagtccctgcacatcgaccggccctccacccacgtcgactggtcctcgggcgccatcgggctgctcaccgaacgcaccccgtggcccgagaccggccggccgcgccgcgccgccgtctcctccttcggcatcagcggcaccaacgtccacaccatcctcgaacaggcccccgcggacgaggcgcccacgcccgccgacccgccgcgggacggcctggtgccggtcctgctctccggccgcggcgaggccgcgctgcgcgcccaggccgcccgcctgctcgccttcgtcgaggagcggcccgaggcccacctcaccgacctcgcccactccctcgccacctcgcgcgccgcgctggaacgccgcgccgccgtcatcgccgccgaccgcgacaccctgacccgcggcctgcgcgccctgtccgacggccggcccgaccccggcctggtccagggcaccgcgggacgcggccggaccgccttcctgttcaccggacagggcagccagcgccccggcatgggccgcgaactccacgaccgctacccggtgttcgccgacgcgctggacgaggtgctggcccggctcgacgacggaccggaccggccgctgcgcgaggtgctgttcgccgcgcccgactccgccgaggccgcgctcctggaccggaccggctacgcccagcccgcgctgttcgccgtcgaggtcgcgctgttccgcctgctgacgtcctggggcctgaccccggactacctggccggccactccgtcggcgaactcgccgccgcgcacgtcgccggcgtgctgtcgctggacgacgcctgcactctggtcgccgcccgcggccggctcatgcaggcgctgcccgagggcggcgcgatggtcgccctggaggccgcggaggacgaggtcctgccgctcctggaggggctcaccgaccgggtgtccgtcgccgccgtcaacgggccgcggtccgtggtcgtcgccggcgtcgaggaggacgtgctcctcctcgccgacctcttcgccgccgacgggcgccggaccaagcggctgcgggtgagccatgccttccactcgccgctgatggacgccatgctcgacgacttcgccgccgtcgcccgcgggctgacctaccacccgccgacgatcccgttcgtgtcgaacgtcagcggcggcctggccaccgccgaacaggtccgcacgcccgactactgggtcgggcacgtccgcgccgcggtccgcttcgccgacggcatcgactggctcgccacccagggcgacgtccacaccttcctggagctcggcccggacggcgtgctcagcgccatggcccgggagagcctcaccgacccgtcccgcacggcactgctgccgaccctgcgcggcgaccggcccgaggaacctgccctggtcaccgcggtcgccgcggcccacgcgcacggcgcccgcgtcgactggagcgggtacttcgccgaccacggcgcgcgccggaccacgctgccgacctacgcgttccaacgcgagcggtactggcccgacaccaccgccgccacgagcgcccacacgcccggatccgccctcgacgccgagttctgggccgccgtcgagcgggacgacgtcgccgccctcgccgcctccctggacctggacgacgccaccgtcaccgcgatggtccccgcgctcaccgcctggcgccggcgccgcggcgagcagaccgaactggactcctggcgctaccgcgtcacctggaagccgcgcggcggcgccaccgcacccgccgccctcaccggccgctggctcgtgctcgtcccgcacgaccaccaggaccgtcaggacgacgcgaccgcggcctgggcagccgacgtcgagaccgccctgggcaccaccaccgtccggctgacggtcaccaccaccgaccgcgccgcgctggccgcccggatcaccgaagccgccggcgaccagggcccgttcagcggtgtgctgtccctgctgccgctcgccaccggcgacgccggccaccccggtgcgcccgccgccctcaccctcaccaccaccgccgtccaggccctcggcgacgccggcatcgacgcgccgctgtggaacgtcacccgcggggccgtggccgtcggccgcgccgaacaggtcaccgcgcccgaacaggccgccgtctggggcctgggccgcgccgtcgccctggaactgccggcccggttcggcggcaccctcgacctgcccgccaccctggacggccaggccgcccgccggttgcgcgcggtgctcgcggctaccgacggcgaggacgcggtggccctgcggccctccggcgtcttcctccgccgcctggcccacgccccggccggccccgacaccgcccgcaccgccttcgacccggcggccggcaccgtcctgatcaccggcggcaccggcggcatcggcggccacgtcgcccgccgcctggcccgcgacggcgccacccacctgctgctcaccagccgccgcggcccggccgcccccggcgccgacgcgctccgcgccgaactggaggaactgggcgcccgggtcaccctcgccgcctgcgacgccgccgaccgcgacgcgctggccgcgctcctcgccgaactgcccgacgacgccccgctgtgcgcggtgttccacaccgccggcgtcgtcgaggaccacgtcgtggacgcgctcacaccggagaacttcgccgcggtgctgcgcgccaagaccgtcgccgcccaccacctgcacgagctgaccgccgacctggacctcgccgctttcgtgctgttctcctccacggccggcgtcctcggcgccgccggacagggcaactacgccgcggccaacgcccacctggacgccctcgccgaacaccgccgctcccacggcctgaccgcgctgtccgtcgcctggggcccgtgggccggctccggcatggtcgccgacgccgccgaactcaccgaccgggtacggcgcggcggcttcgaaccgctcgcccccgaaccggccgtgcgcgccctgctgcgcgccatcgagaacgacgacaccaccgtcgcgctcgccgacatcgactgggagcgcttccagcgcgccttcgccgcggtccgcccgctgccgttcgtcgccgacctccccgagaccggccgggccacccccgcgaccgccaccggcgccgccaccggcctgcggcagcaactcgccgaactgccggagcacgagcgcccggcagcggtcctggacctgctgcgtacccaggtcgccgccgtcctcggccacgccgacccgcgcaccgtcgaggacgaccacgccttccgcgacctgggcttcgactcgctgaccatcctggaactgcgcaacgccctcaacgccgccaccggcctgagcctgcccgccaccctggtctacgacctgcccaccccgcgcgagatggcggacttcctgctcgccgaactcctcggcaccctgcccaccgacaccgccgcgaccgtcgccagcacggcctcccccaagctctcagcttcgttcgagcagggcggtacccccttcgacgacccgatcgccgtcatcggcatcggctgccgcttccccggcggcgtcaccaccccggaggagctctggcagctcctcgacgagggccgcgacggcatcagccgcttccccgacgaccgcggctgggacctcgccgcgctgggcgccggcgcctccgacaccctggagggcggcttcctgaccggcgtcgccgacttcgacgcccggttcttcggcatctcgccccgcgaggcgctggccatggacccccagcagcggctgctgctggagaccacctgggaggcgctggagcgggccggcatcgacccgaccacgctgcgcggctccaccaccggcgtcttcgtcggcaccaacggccaggactacccgacgctgttgcgccgctccgcctcggacgtggccggctacgtcgccaccggcaacaccgccagcgtgatgtccggccgcctgtcctacgcgctcggcctcgaaggcccggccgtcaccatcgacaccgcctgctcctcctcgctcgtcgccctgcactgggccggccgggcgctgcgcgccggcgagtgcgacctcgtggtggccggcggcgtctcggtcatggccagcccggactccttcgtcgagttctccacccagggcggcctggcacccgacgggcgctgcaaggcgttctccgacgccgccgacggcaccgcctggtccgaaggcgtcggcatcctcgtcctggaacgcctctccgccgcccgccgcaacggccaccaggtcctcggcctgatccgcggcaccgccgtcaaccaggacggcgcgtccaacggcctgaccgcgcccaacggcctctcccagcagcgcgtcatcgcccaggcactcgccgacgcccgcctgcgccccgccgacatcgacgcgatcgaggcgcacggcaccggcaccaccctcggcgacccgatcgaggcccgcgccctgatcaccgcctacggccgggaccgggacgccgaacggccgctgctgctgggcaccgtcaagtccaacatcgggcacacccaggccgccgccggtgccgccggcgtcatcaagatgctgatggcgatgcgccacggcaccctgcccaggacgctgcacgtgggcaccccgtccagccacgtcgactggagcggcggcaccgtcgcgctcctcgacgacgcgcggccctggccacggaccgggcagccgcggcgcgccggcgtctccgccttcggcgtcagcggcaccaacgcccacgtcgtcgtcgagcaggccccggaaaccgaagcccccgccgccccggccgccgagccggcgccggaggccacgcccaccgtcgtcccctgggtcgtctccggacgcagccgggaagcgctccaggcgcagctggaccggctcaccgcgcacaccgccgcccaccccgcgcgctcggcggcggacgtcggccgctcgctggccaccgaccgcacgctcttcccgcaccgcgccgtgctgctcgccggcccggacggggtgcgcgaggccgcccgcgccgccgcgccccgcacccccggccgcaccgcgttcctgttctccggacagggcgcccagcacgccctgatgggccacgacctgtaccagcgcttcccggtctacgccgacgcactggacaccgtcctcgcccagttcgacaccgtgctggacgtcccgctgcgcgccgcgctgttcgccgcgccgggcacccccgaggccgcgctcctggaccagaccggcttcacccagcccgcgctgttcgccgtcgaggtcgcactgttccggctcgccgagtcctggcggctgacgccggacttcgtcgccggccactccatcggcgagatc

SEQ ID NO: 3 - protein, 345 aa, Streptomyces noursei
MSFTYPVSMPWLQGRELDYVTEAVGGGWISSQGPYVRRFEEAFAAYNDVPFGVACSSGTTALTLALRALGVGPGDEVIVPEFTMIASAWAVTYTGATPVFVDCGDDLNIDVSRIEEKITPRTKVIMPVHIYGRQCDMDAVLNLAYEYNLRVVEDSAEAHGVRPRGDIACFSLFANKIISAGEGGVCLTHDPHLAEQMAHLRAMAFTKDHSFLHKKLAYNFRMTNMQAAVALAQTEQLDTILALRRDIEKRYDEALRDIPGITLMPPRDVLWMYDLRAERRDELCAYLAGEGIETRVFFKPMSRQPGYFSADWPALNAARLSADGFYLPTHTGLTAQEQEFITGRI

SEQ ID NO: 4 - protein, 506 aa, Streptomyces noursei
  MISC_FEATURE (1)..(1): Xaa is Val or Met
XTLPSGNTRLGWRRRRMHSPGDRAGRVRGARARRPATFRGVLSMGANRRPILFVSYAESGLLNPLLVLAGELSRRDVADLWFATDEKARDEVAAVVDGSPVRFASLGDTVSQMSAVTWDDATYAEVTQRSRFKAHAAVIRHSFAPESRMAKYRRLEEIVEEVEPALMVIESMCQFGYELAITKGIPFVLGVPFVPSNVLTSHVPFAKSYTPSGFPVPHSGLPAAMSLAQRIENQLFRLRTLGMFLTSDVRKVVEEDNRVRTELGIAPQARQMMARIDHAEQVLCYSVRELDYPFPMHPKLRLVGTMVPPLPQAPDDDGLSDWLSAQKSVVYMGFGTITRLTREQVASLVEVARRLDGRGHQVLWKLPRGQQELLPPAAELPDNLRIEGWVPSQLDVLAHPNVKAFFTHAGGNGYHEGLYFGKPLVVRPLWVDCDDQAIRGQDFGVSLTLDRPETVDTEDVLDKITRVLDQPSFTERAEHFAGLLRDAGGRAAAADLLLGLPALATD

SEQ ID NO: 5 - protein, 1366 aa, Streptomyces noursei
MTIGADEDPVVVVGMACRYPGGVAGPEDLWELVRTGRDATTAFPDDRGWDLAALAGDGPGRSATREGGFLTGAADFDAAFFGMSPREAVSTDPQQRLVLETAWEALERAGIDPHSLRGSRTGVFVGASGQDYAAVTHASPDDLDGHALTGLAPGVASGRLAYVLGLEGPAVTVDTTSSSSLVALHWAVRALRAGECSTALAGGVTVMSTPAAFVGHTRQGGLAPDGRCKPFSDDADGTAWAEGVGIVVLEHLSTARAAGNPVLAVLRGSAVNQDGASDGLTAPSGPAQERVIRAALADARLAPADIDLVEAHGTGTRLGDPVEARALLAAYGQDRDPDRPLRLGSLKSTLGHAQAAAGIGGVIKTVLTLRHGLMPRIRHLATPTRQVDWSQGAVAPLTDHTPWPPADRPRRAGVSSFGISGTNAHVILEEAPPADVPVTRPGTLRPSTVPWPVSAATPEALDAQLARLRAHLRTHSDLDPLDVGYSLATGRAALRHRAVLLPPADGTAADAVEHARGAAHQRRTAVLFSGQGSQRPGMGRELAARFPVFADALDDALRALDRHLDGPVREVMWGTDAALLDRTGWTQPALFAVEVALHRLVASLGVTPDFVGGHSVGEIAAAHVAGVLSLEDACRLVAARATLMQALPAGGAMAALEATEDEVAPLLGAHLALAAVNGPTAVVVAGAEDAVRQLTARFADRGRRTSRLAVSHAFHSPLMEPMLDAFRDVVSRLTFHQPSIPLVSNLTGELAGSEITSAEYWVRHVRDTVRFADGITALAKAGADVLIELGPGGVLSAMARDTLGPDSTTDVVPALSKGRPEETAFAGALGRLHTLGVPVDWPAFYAGTGARRVELPTYAFQHVRHWPTPPRPNGAGPGALGHPLLGSAVELADGGGTVCSGALSLRTHPWLADHTVAGRVVLPATALLELAVRAGDEAGCDVLHELHLTTPPALPDDAALHVQVHVGPADTTGRRAVTVHTRPDHHPAGDWTRCATGTLGSTPPSAAEAATGGTPAAWPPADAEPLDLADHYERLADRGFDYGPTFRGLRAAWRRGAEIFADVECPPGTADDAPDHGLHPALLDAARHAAMAVDGTVPVAWHGVRLHAVGATALRVRIRPTTTGTLTLTAVDVHGAPVVTVEALTARPLTDEERAAPRTPRQARGETPADARPARPAAARPGPAGEPLPDTTGSHPTAGHLAALPPAARERQLLDLVRTQAAAVLGHPGPEAVGTRSVFKELGFDSLAGVELADRLTARTGLRLPATLVFNFPTPERAAHRLGELLAATAPLDPGAYGEELTRFEAIVTNLPQDGPERRAVADRLDAIVSALRQNSPAEVPSSDEDIDTVSVDRLLDIIDEEFETT

SEQ ID NO: 6 - protein, 3192 aa, Streptomyces noursei
MQEPQQGQPDQQEKIVDYLRRVTSDLRRARRRIGELESKDNEPIAIVGMGCRLPGGVNSPESLWDLVRSGGDAISGFPVDRGWDLETLTGNGDGSSATHEGGFLYDAAEFDAAFFGISPREATAMDPQQRLLLEVAWEALERAGIAPTALRGSRSGVFVGSYHWGAPSADAATELHGHALTGTAASVLSGRLAYTLGLEGPAVTVDTACSSSLVALHLAAQSLRVGESSLAVIGGVTILTEPSVFVEFSAQGGLAPDGRCKAFSDAADGTGWAEGVGVLVAERLSDAQRNGHPVLAVLRGSAVNQDGASNGLTAPNGPSQERVIQQALARTGLTPADIDAVEAHGTGTRLGDPIEAQALLATYGQGHTPDQPLWLGSLKSNIGHTQAAAGVAGVIKMVMALRHGHLPPTLHADAPSSHVDWSAGSVRLLTEGQQWPETGRPRRAAVSSFGISGTNAHALLEQAPHPADTADAGDDAAPTEPAGAPAALPWIVSGHSPQALRDQAAALAARVETDPALRPQDIGHTLHTARALLERRAVVVAPDRAELLAATHELAAGRSANAVVEGLADVEGRTVFVFPGQGSQWVGMGAQLLDESAVFAERIAECAAALAEFTDWSLVDVLRGVVGAPSLERVDVVQPASFAVMVSLAALWGSRGVLPDAVVGHSQGEIAAAVVSGALSLRDGARVVALRSQAIGRALAGRGGMMSVALSVDVLEPRLVEFEGRVSVAAVNGPRSVVVAGEPEALDALHARLTADDIRARRIAVDYASHSHQVEDLHEELLEVLAELAPRTSEVPFFSTVTGDWLDTARMDAGYWFRNLRGRVRFADAVADLLAAEYRAFVEVSSHPVLTMAVLDLIEEAGVTAVATGTLRRDQGGAGRFLLSAAEVFVRGVDVDWAGAFEGTGAARVDLPTYAFQRERYWNTRTAADRTPADAPMDAEFWAAVEQADVSALTAALGTDEDSVAAILPGLTSWRRARSQRTTLDSWRYRVTWTPLAQVPRATLTGTWLLVTTDGIDDTDVAGALESYGAEVRRLVLDEECTDRAVLRERLAGAEDVTGIVSVLAAAEDDAARHPGLTRGLALTVSLVQALGDAEATAPLWFLTRGAFATGPSDPVTRPLQSQIAGVGWTTALEHPQRWGGTVDLPDTLDARAAQRLAAALSGALGAEDQLAVRAAGVLARRIVRAGHRAGRPARTWAPRGTTLITGGSGTLAPQLARWLAERGAEHVVLVSRRGADAPGAPELIAEAAESGTEVTVAACDITDRDAVAALLADLTADGRTLRTVIHAAAAIELSALADTTVAEFADVVHAKVTGARILDELLDDAELDDFVLYSSTAGMWGSGVHAAYVAGNAYLSALAEQRRARGLRTTSIHWGKWPDDRARELADPHRIRRSGLEYLDPELALTALQHVLDDDETVIGLMDIDWDTYHDVFTAGRPAHLFDQIPEVRRRLDQASVPDPAGPAADGLAARLHGLAAAEQDRLLLTLVRTEAAAVLGHASAESFPERRAFRDLGFDSVTAVDLRNRLVAGTGLRLPSTMVFDHPNCAALAAFLKTTALGVPGAAPQQHAATGTPADDDPIAVIGMSCRYPGGAATPEELLRLALDGADVISEFPADRGWDARGLYDPDPDRPGHTYSVQGGFLHEAAGFDPGFFGISPREAVAMDPQQRLLLETSWEAFERAGIDPASLRGSAAGTFFGASYQDYSSTVQNGTGESEAHMVTGTAASVLSGRVSYLLGLEGPAVTVDTACSSSLVALHLACQSLRDGESSLALAGGAAVMATPHAFVGFSRQRALAKDGRCKPFSDTADGMTLAEGVGVVLLERLSHARANGHRVLAVIRGSAVNQDGASNGLTAPNGPSQQRVIRQALANAGLTGADVDAVEAHGTGTKLGDPIEAQALLATYGQDRDAERPLLLGSVKSNIGHTQAAAGVAGVIKMVLAMDAGELPGTLHLDAPSSHVDWTAGAVELLRGRTPWPESGRPRRAGVSSFGISGTNAHLILEQAPATEPPADPDRLRDTATDTVVPWPLAAKSPAALRAQAARLLATVEHDPDLPPAPVGHALATTRAALEHRAVVVGERREDFLRGLAALSTGASTAGLVSGIAGPDPEGAVFVFPGQGSQWWGMGRELLATSEVFRTAIDDCATALAPYVDWSLHDVLAGEGDPALLERVDVVQPALFAMMVGLSALWRSHGVVPAAVVGHSQGEIAAACVAGALSLADAARVVALRSQALPQLSGRGGMMSVSAPVERVTALLAPWQEALSVAAVNGPSSVVVSGDTDALDALHTACQEQGVRARKVSVDYASHGRHVEAVRDELARVLAPVDPRAPEVPFYSTVTGDRVDDAAFDGAYWYTNLRQTVRMEEATRALLAAGHRVFIEVSPHPVLAAPIQETQEAVAEATGGSAVVLGSLRRDEGGPRRFLTSLAEAHTHGAPVDWTTTFARSAYQPVDLPTYPFQRQDFWPEARPATPAAGADASDAAFWQLVENQDLAALADALGVPADDEHTALGTVLPALSAWRAKAQARTRIDELRYHVQWTRVAEPAAAPTTGRLLVAVPPDHADAPWVAAALDALGTDTVRFEAKGTDRAGWAAQIAQLVEDGEEFTGVVSLLAAAEDLHPDFGSVPLGLGQTLVLVQALGDAGLTAPLWCLTRGAVATGRDDALDSPTQGALWGLGRVVALEHPDRWGGLIDLPATLDARAAARLTGLLADPAGEDQLAVRATGVLARRMVHAAPSAPRTGRRWRGRGTCLITGGTGGIGGRVARWMAEHGAAHLVLTSRRGPDAPGAAALRAELEALGARVTLAACDVADRDALAALLADLPADQPLTSVFHSAGVADGDARAADLTLDQLDALLRAKLTAAHHLHELTAPLDLDAFVLFSSGAAVWGSGGQPGYAAANAYLDALAAHRRSLDLPGASVAWGTWGEVGMATVPEVHERLHRQGVRAMEPDHAIGALQQMLEDDDTTLAVTLMDWEAFAPSFTATRPSALFSTVPEAVRAVTGDPGTTAGDDVDSATPPLRRHLEELSAAERGRALVEAVRAEASATLGHDTPDAIPAGRAFRDVGFDSVTAVELRNRLRTALGLPLPAALVFDHPTPTALAGHLGALLFGTAPEDAGTGRPDDPDARIREALATVPIGRLRKAGLLDMVLKLADGDATDAPAPEADAPSESLDDMDAEALLRLATENSAN

SEQ ID NO: 7 - protein, 11096 aa, Streptomyces noursei
MSTNPDKYVEALRSSLKEIERLRRQNEQLVAAAVEPVAVVGIGCRFPGGVTSPEDLWELVAEGRDVIGPFPQDRGWDLEKLAGGGEGGSLAQVGGFVEDAAGFDPGFFGISPREAVAMDPQQRILLEITWEALERAGIDPSTLRGTPTGVFVGTTGQDYGEVIKASAEDVEVYSTTGHAASVISGRLSYTLGAEGPAVTVDTGCSSSLVALHWAVQALRGGECSMALAGGASIMATPGPFVAFTAQSGLAADGRCKPFSDRADGTGWGEGAGMLVLMRLSDAQREGRPVLAVLRGSAINQDGASNGLTAPNGPSQQRVIRAALDSAHLTAADIDAVEAHGTGTTLGDPIEAQALLATYGQDRPRPLWLGSVKSNIGHTQAASGAAGVIKMIMALQRGVLPRSLHATEPTTDVDWTAGSVDLLDETVAWPETGRARRAGVSSFGISGTNAHVILEQAPTAPEEPTTEPTVRPAVVPWALSARTAAALDAQRARLTGHLADTPDADPLDVGYALADGRATFEHRAVLLPDGTELAHGTAGEGPCAVLFSGQGSQRPGMGRELHARFPVFAAAFDEITALLDTHLDRPLREVVWGTDADLLNDTGWAQPALFAVEVALYRLVASLGVTPDFVGGHSIGELAAAHVAGVLSLEDACTLVAARARLMQALPRGGAMLAIRATEDEVTPHLTDDVSIAAVNGPTSVVVAGTEEAVAAIGARFTAQDRKTTRLRVSHAFHSPLMDPMLAEFRAVAAGLTYHEPRIPVLSNLTGTVAAVADLCSADYWVRHVREAVRFADGVTALTDRGVTTLVELGPDGVLSAMAQESLPDGAAAVPLLRKDRPEELSAVTGLARAHVRGVTVRWAGLFDGTGARRADLPTYPFQHQRFWPTAARAAQDVTAAGLGAADHPLLGATVELADGAGYLFTSRLSVRTHPWLADHGVQGRALLPGTAFVELAVRAGDEAGCDRVEELTLAAPLVLPERGGVQLQVRVGAPDAAGRRTLGIFSRVEDGFDLPWSQHATGVLTAGAGAPDPTFDATVWPPSGAEPVDLTGAYERLAALGFQYGPAFQGLRAAWRRDTEVYAEVALPDGADTDPAAFGLHPALLDAAQHAAAYADLGAISRGGLPFAWEGVSLAAAGATTVRARIAPAGEDTVTIAVYDAAGGTVLSVDSLVSREVPADAPGAAGTVHRDSLFHVEWTPLQGRPGPAPATVAVLGPDPDALADTLRATGIRTTAPRDLAALADAEGPVPDLVVTTLTTTPGAPVPDAAHATTAAVLALAQQWLADDRFADARLVLVTRGATDGTDPAAAAAGGLIRTARTENPGRFALLDLAPDTGRPDPETLATALAASHDEPDLAVRGTDVHAARLARVPLATEPTTWNPDGTVLITGGTGGLGAVLARHLVATHGVRHLLLASRRGPAADGADDLTAELTGLGATVHIAACDVADPAALADLLGTVPAGHPLTVVVHTAGVVDDGVLGSLTPQRLDTVLRPKADAAWHLHEATRHLDLDAFVLFSSVAATLGSPGQANYAAGNAFLDALAARRAATGLPATSLAWGPWTQSVGMTSSLSDLDVERIARSGMPPLTLEQGTALFDAALAAGPAALAPVRLDLPVLRTQGDIAPLLRGLIRTPVRRTAAQVSQTADGLAQRLAGLDAAARREALLELVRTQIAQVLGHADATEVETGRQFQDLGFDSLTAVELRNALNTATGLRLPATMVFDYPTPHALADHLRDELLGTEAESTTAVPVPTRTAGTDDPIVIVGMACRYPGGIASPEDLWRLVSQGADATGPFPTNRGWDLDNLYDPDPDRPGRTHVRAGGFLHDAGSFDADFFGMSPREAMATDSQQRLLLELSWEAVERAGIDPASLRDSGTGVFAGVMYNDYGTTLTGDEYEAFRGNGSAPSVASGRVSYTLGLEGPAVTVDTACSSSLVALHWAAQALRAGECSLALAGGVTVMSTPSTFVEFSRQRGLAPDGRSKAFAEAADGVAWSEGVGMLVLERQSDAVRNGHEILAVVRGSAVNQDGASNGLTAPNGPSQQRVIRQALASGGLSTADVDAVEAHGTGTTLGDPIEAQALLATYGRDRDPENPLLLGSIKSNIGHTQAAAGVAGVIKMVMAMRHGVLPQTLHVDAPSSHVDWSVGAVELLTEQTAWPETGRARRAGVSSFGISGTNAHVVIEQSPTAVPATPASADRSVEEPPAVPWALSGKTPDALRDQAARLLAHVEAHPALRPVDISYSLIATRTAFDHRAVVLGTDRAEALRALTALAAGETDPAALTGTVRTGRTAFLFSGQGSQRLGMGRVLYERFPAFAEALDTVLTALDAELGHPLRDIIWGEDAQLVDRTGYTQPALFAIEVALFRLLEAWGITPDFVAGHSIGEIAAAHVAGVLSLGDACRLVVARAVLMQSLPEGGAMIAVQATEDEVLPLLTDDVSIAAVNSPTSVVVSGYENATLAVARHFADQGRRTTRLRVSHAFHSPLMAPMLDDFRAVVESLTFTAPTTPVVSNLTGELAPAEALCSADYWVRHVREAVRFADGIRTLADRGVTTFVELGPDSVLSAMAQESAPEGAGTIPLLRRDRPEEQAVLAALCHLQVLGVEADWSATFRGLDPVRVDLPTYAFQHRWFWPAARPARPDDVRAAGLGAAEHPLLGAAVQLPDDDGALFTGRLSLRTHPWLADHTVLGTVLLPGTALVELAVRAGDETGSGHLEELTLAAPLTLPEDGATLLQVRVGSADDTGRRTVTVHARPDDTADRTWTLHATGVLATTPPAAAAFDTTVWPPADAEPLTTDDCYAHFTTHRFAYGPAFQGLRAAWRAGDVLYAEVALPESATDEAAAFGLHPALLDAGLHAALLADDRDTGLPFSWEGVTLHASGATALRVRLAPNGPNGLSVTAADPAGNPVATVTRLLARPLDAEQLTIHSALTRDALFHLDWTPVPLPDTANSAPPALLGPDTAVLADALGDPAVARHATLDDLLAGDTTPPATVLVPLGAPLDGDTAQHAHALTRSALTLVQQWLATDRLADSRLVFVTHGAVATDDAPPTDLAAAAVWGLIRSAQTENPGTFTLLDLDTEPDSTTALSRALTLDEPQLLLRAGRARAARLTRTPAPTTTTHTPWSADGTVLVTGGTGGLGGLVARHLVRSCGVRHLLLTSRSGVGAAGAAGLVAELESLGARVVVAACDVGDGSAVAELVAGVSESYPLSAVVHAAGVLDDGVVGSLTPERLAAVLRPKVDGAWNLHEATRGLDLDAFVVFSSVAGVFGGAGQANYAAGNAFLDALMVHRVAGGLPGVSLAWGAWDQGVGMTAGLTERDVRRAAESGMPLLTVDQGVALFDAALATGSAALVPVRLDLAALRTRGDIAPLLRGLVRAPLRRTAATGLATGADTGLVQRLGRLDHAQRHEALLDMVRSSAALVLGHADGNAIDAERAFRDLGFDSLTAVELRNRLRTATGLHLSATMVFDHPTLSALAEHLRDELFGAVESEVRVPVQALPPTADDPIVVVGMACRFPGGVTSPEDLWRLVDDGTDAITTFPTNRGWDLDNLYDPDPEHFGTSYTRSGGFLHEAGEFDPAFFGMSPREALATDSQQRLLLESSWEAIERAGIDPLTLRGSATGVFAGVMYSDYGSILGGKEFEGFQGQGSAGSVASGRVSYALGFEGPAVTVDTACSSSLVALHWAAQALRAGECSLALAGGVTVMSTPSTFVEFSRQRGLAPDGRSKAFAEAADGVGWSEGVGILVLERQSDAVRNGHEILAVIRGSAVNQDGASNGLTAPNGPSQQRVIRQALASGGLSTADVDAVEAHGTGTTLGDPIEAQALLATYGRDRDPENPLWLGSLKSNIGHTQAAAGVAGVIKMVMAMRHGVLPQTLHVDAPSSHVDWSVGAVELLTEQTAWPETGRVRRAGVSSFGISGTNAHVIVEQPALVESPAAEPSGREPGVVPLPLSGKSPEALRDQAARLLAGLAERPALRPLDLGYSLATTRSAFDHRAVVLATDRADAVRALTALAAADADLSAVVGDTRTGRHAVLFSGQGSQRLGMGRELYERFPVFAEALDVAIDHLDAALPAQASLREVMWGDDVELLDETGWTQPALFAVEVALFRLVESWGVRPDFVAGHSIGEIAAAHVVGVFSLEDACRLVAARATLMQALPTGGAMIAIQAAEDEVTQHLTDDVSIAAVNGPTSVVVSGAESAARTVADRLAENGRKTTRLRVSHAFHSPLMDPMLAEFRAVAEGLSYATPTLPVVSNLTGRLATADDLCSAEYWARHVREAVRFADGVSTLENEGVTTFLELGPDGVLSAMAQQSLTGDAATVPALRKDRDEETSALTALAHLHTAGLRVDWAAFFAGSGATRVDLPTYAFQHATYWPTGTLPTAHAAAVGLTAAEHPLLNGSVELAEGEGVLFTGRLSLQSHPWLADHAVMGQVLLPGTALLELAFRAGDEAGCDRVEELTLAAPLVLPERGAVQTQVRVGVADDTGRRTVTVHSRPEHATDVSWTQHATGTLTMGSAPADTGFDATAWPPADAEPLATDDCYARFTTLGFAYGPVFQGLRAAWRAGDVLYAEVALAESTGDEATAFGLHPALLDAALHASLVAHEGEESNGGLPFSWEGATLYATGATALRVRLTPTGTDGRSVAIAVADTAGRPVAAIDNLVSRRVSGDQLTGAAGLARDALFTLDWNPVPENLVPENPVPENTGGGHAQDQDGRPAAATVALVGADGTAIAADLTAAGIHTTLHPDLTTLATTDADVPKTVLIPLTGTGTGTGTGTESTDGIGTGAAESDASAPSPAEVAHTLSTAALALVQEWTAQERFAGSRLAFVTTGATAAGGTDVMDVAAAAVWGLVRSAQSEAPDTFVLIDRDPGPAGTHDRTAAAERGQLLLRALHTDEPQLALRDGGVLAARLARFDTAAALTPPADRAWRLDSTAKGSLNGLALTPYPAALAPLTGHEVRVEVRAAGLNFRDVLNALGMYPGDDVGSFGSEAAGVVVEVGPEVTGLAPGDQVMGMITGSFGSLAVDDARRLARLPEDWSWETGASVPLVFLTAYYALKELGGLRAGEKVLVHAGAGGVGMAAIQIARHVGAEVFATASEGKWDVLRSLGVADDHIASSRTLDFEAAFAEVAGDRGLDVVLNSLAGDFVDASMRLLGDGGRFLEMGKTDIRAADSVPDGLSYQSFDLAWVVPETIGTMLAELMDLFRTGALRPLPVRTWDVRHAKDAFRFMSMAKHIGKIVLTLPRSWKPEGTVLVTGGTGGLGGLVARHLVRSCGVRHLLLTSRSGVGAAGAAGLVAELESLGARVVVAACDVGDGSAVAELVAGVSESYPLSAVVHAAGVLDDGVVGSLTPERLAAVLRPKVDGAWNLHEATRGLDLDAFVVFSSVAGVFGGAGQANYAAGNAFLDALMVHRVAGGLPGVSLAWGAWDQGVGMTAGLTERDVRRAAESGMPLLTVDQGVALFDAALATGSAALVPVRLDLAALRTRGDIAPLLRGLVKAPIRRAAATTPGDTGLAEQLTRLQRAERRDTLLALVRDQAAMVLGHTSGDGVDPSRAFRDLGFDSLTAVELRNRIGAATGLRLPATAVFDYPTADALAAHLLTELLGPDAESDPDEPGDPTAGPTDDPIVIIGMSCRFPGDIGSPEDLWRLLGDGADVVTDFPTNRGWDLDNLYDPDPAHAGTSYARTGGFLHDAADFDADFFGMSPREAMATDSQQRLLLESSWEAIERAGIDPLTLRDSRTGVFAGVMYSGYGTRLDGAEFEGFQGQGSALSVASGRVSYTFGFEGPAMTVDTACSSSLVALHLAAQALRGGECTLALAGGVTVMSIPDTFIEFSRQRGLAPDGRSKPFSESADGVGWSEGVGMLLLERQSDAVRNGHQILAVVRGSAVNQDGASNGLTAPNGPSQQRVIRQALASGGLSTADVDAVEAHGTGTTLGDPIEAQALLATYGRDRDPENPLLLGSIKSNLGHTQAAAGVAGVIKMVMAMRHGVLPRSLNITEPSSHVDWSAGAVELLTEQTAWPETGRARRAGISSFGISGTNAHVILEQPEAARHSAPEEADTAEAAAKAPATAHLPVMPWALSGKTPEALRAQAARLLAHLQQRPELAPADIALSLATQRSQFTHRAVVLSTDRDEATRALSALATTAASDPSALTGTVTMGRCAVLFSGQGSQRLGMGRELYERFPVFAEALDVVIDHLDAALPAQAGLREVMWGDDVELLNETGWTQPALFAIEVALFRLVESWGVRPDFVAGHSIGEIAAAHVVGVFSLEDACRLVAARATLMQALPAGGAMIAVQATEDEVIPHLTDEVAIAAVNGPTSVVISGAEEATQTVAQHFADQGRRTTALRVSHAFHSPLMMLAEFRAVAEGLSYATPTLPVVSNLTGQVATADELCSAEYWVRHVREAVRFADGVTALEAEGVRTFLELGPDGVLAAMARETVADDTVTVPVLRRNMPEERTLLTALGRLHTTGTPIDWAALLAPTGARPVDLPTYAFQHRPFWPSGPRDTADAAAVGIAGASHPLLNGIVELADEEGLLFTGRLSLQSHPWLADHAVMGQVLLPGTALLELALRAGDEVGCDHVEELTLAAPLVLPERGAVQTQVRVGVADTTGRRTVTIHSRPARATTTDSDTHTGTDTPWTQHATGVLVAGLPATATVPFDATVWPPAHAEPVDLADFYASRAGEGFGYGPAFQGLRAAWRRDGEVFADVALPEAGRTEAEAYGLHPALLDAGLHAAWLVAPDGEPTRTGSVPFSWRGVFLAASGASSVRVRLGRDSDGTLSLAIADTTGAPVASVQALSMRTVSVTALSATAGLARDALFRLDWASAPEPACQPDDTVTVIPAVAVVGTETSELTSELTAALRAAGADVDVRTTLSTDEPAPALIALPLVASDQTGTAEAAPVPAAVHDLTRRALALVQTRLQEQHFADTKFVFVTRGATVGRDVAAAAVWGLVRSAQSENPGCFALVDLDPDGAVGAAALVAALVSGEPQLAVRGDVLRVARLVRRPLTEVGAGADGTGDGVGGGSGVSFSGEGAVLVTGGTGGLGAVLARHLVAEYGVRDLLLVSRSGERAVGAGELVAELAGVGARVRVVACDVTDRAAVVELVGGHAVSAVVHAAGVLDDGMVGALTGERLSAVLRPKVDAVWHLHEATRGLDLDAFVVFSSLAGVFGSPGQANYAAANAFLDALMTRRRAEGLPGLSLAWGPWSLTDGTSGMLADAEADRLTRSGVPPLTAEQGLALFDAALATGDATCVPVRLDLSALRAQGEVPPLLRSLIRGRSRRAAAAESATATGLRERLVGLNPVERQEVLLDLVRGQVALVLGHADADDVHPARAFRELGFDSLTSVELRNRLNTVTGLRLPATMVFDYPTVEVLVSYVLDELLGTDAEVATVQPAAVAVADDPIVIVGMACRYPGGVASPDDLWRLVTDGVDAVSPFPTNRGWDVESLYHPDPDHLGTSYTRSGGFLHEAGEFDPGFFGMSPREALATDSQQRLLLESSWEAIERAGIDPVSLRGSRTGVFAGVMYSDYSAMLASPEFEGFQGSGSSPSLASGRVAYTLGLEGPAVTVDTACSSSLVAMHWAMQALRSGECGLALAGGVTVMSTPAVFVDFARQRGLSPDGRCKAFADAADGVGWSEGVGVLVLERQSDAVRNGHEILAVVRGSAVNQDGASNGLTAPNGPSQQRVIRQALASGGLTAGDVDVVEAHGTGTTLGDPIEAQALLATYGRDREPERPLLLGSVKSNLGHTQAAAGVAGVIKMVLAMRHGVVPRTLHVDAPSSHVDWSEGAVELLSEQAAWPETGRVRRAGVSSFGISGTNAHVILERPEAARRPVMETNTVEPSTVPWVLSGKTPEALRAQAAKLLSSIEERPELRLVDVGMSLVTGRSTFEHRAVVLAADRADAARALSAIAADEADAAAATGRVGAGRHAVLFSGQGAQRLGMGRELYERFPVFAEALDVVVDHLDAALPAQAGLREVMWGDDAELLNETGWTQPALFAIEVALFRLVESWGVRPDFVAGHSIGEIAAAHVAGVFSLEDACRLVAARATLMQALPAGGAMIAVQATEDEVTPHLTDDVAIAAINGPNALVVSGVEDAAVEIGARFAAEGRRTTRLHVSHAFHSPLMDPMLAEFRVVAEGLSYAAPSLPVVSNLTGQVATADELCSAEYWVRHVREAVRFADGVTALEAEGVRTFLELGPDGVLAAMAGASLTESSLAVPLLRKDRPEEPAALAALAQLHIAGARVDWPVLFAGVGAGRVELPTYAFQRGWFWPVGRVGVGGDVGAVGLGSAGHPLLGAAVELAAGAGVVLTGRLSLSSHGWLADHAVMGRVFVPGTALLEMVMRAGDEVGCGRVEELTLAAPLVLPERGGVRVQVAVDAPDAAGRRGVGVYSCPDGVGQAVWSQHAVGVLASGVADQVGGFGDGGVWPPQGAVSVDAEGCYELFADAGFGYGPVFQGLRAVWRRGEELFAEVALSDEVAESADTATGFGLHPALLDASLHASLLSSLEGQSADGGPALPFAWEGVSLFASGATALRVRLAPAGEHAVSVTAVDPTGAPVISIDALRTRRLTLDEVNASHTQLSDALFGVQWTTVPSTPAADHPSVAIIGTDHLGLAEALSSSSAGATTTTTAAAYESLDALIAAGPEVSVPDVTLIGLTTEDAIAQYVNDHDATVAGQGTIGAGAAAVDAARRLTAEALRTIQAWLADERLAARRLVFVTRGAADGQDVAAAAVQGLVRSAQTENPGTFGLLDLDGTEASTAVLGEALTSDEPQLLLRDGHLHAARLTRLASPADTAVPTEWNADGTVLITGGTGGLGAQFARHLVDRYGVRNLLLVSRRGPDAPGTTELVAELTAHGAEVAVQACDVADGDAVAALVAGVPDEHPLRAVVHTAGVLDDGVIGSLTEERLATVLRPKADAAWHLHEATRGLDLDAFVVFSSVAGVFGGAGQANYAAANAFLDALMAQRRAAGLPGLSLAWGPWDQTGGMTGMLSDAEADRLARSGIPPLSAEQGLALFDAALALAGTSTPDRAAGSAAASTSGTGDTIAIPAAALVAPVRLDLAALAAQGEVPAILRGLVRTRTRRTAAGGSVTVAGLVNRLSGLTADERRQELLELVRTQAALVLGHADPASVDSTAQFRDLGFDSLTAVELRNRLSTATGLRLTATLVFDYPNTDALAEHLRDELFGAVESEVRVPVQALPPTADDPIVVVGMACRFPGGVTSPEDLWRLVDAGTDAITTFPTNRGWDLESLYDPDPAHLGTSYTRSGGFLHEAGEFDPAFFGMSPREALATDSQQRLLLESSWEAIERAGIDPLTLRGSATGVFAGVMYSDYGSILGGKEFEGFQGQGSAGSVASGRVSYTLGFEGPAVTVDTACSSSLVALHLAAQALRAGECTLALAGGVTVMSTPGTFVEFSRQRGLAPDGRSKAFAEAADGVGWSEGVGILVLERQSDAVRNGHEILAVIRGSAVNQDGASNGLTAPNGPSQQRVIRQALASGGLSTADVDAVEAHGTGTTLGDPIEAQALLATYGRDRDPENPLLLGSIKSNLGHTQAAAGVAGVIKMVMAMRHGVLPQTLHVDAPSSHVDWSVGAVELLTEQTVWPETGRVRRAGVSSFGISGTNAHVILEQPEAVQRLAPGAAETVEPVAIKPSAEPSLVPWALSGKSPEALRAQAARLRDFLAERPEPRSIDIGHSLAVTRSQFDHRAIVLVDDAKAPADSLAALAALASGVADPAVVSDAVSTGGSAVLFTGQGAQRLGMGRELYGRFPVFAEALDVVVDHLDAALPAQAGLREVMWGDDVELLNETGWTQPALFAVEVALFRLVERWGVRPDFVAGHSIGEIAAAHVAGVFSLEDACRLVAARATLMQALPTGGAMIAVQATEDEVTPHLTDEVAIAAVNGPTSVVISGAEEATQTVAQHFADQGRRTTALRVSHAFHSPLMDPMLAEFRAVAEGLSYATPSLPVVSNLTGWLATADELCSAEYWVRHVREAVRFADGITTLEAEGVRTFLELGPDGILSALAQQSLAGEAVTVPVLRKDRGEESTALTARAHLHTRGLIEDWQDFFAGVGAGRVELPTYAFQRGWFWPVGRVGVGGDVGAVGLGSAGHPLLGAAVELAAGAGVVLTGRLSLSSHGWLADHAVMGRVFAPGTALLEMVMRAGDEVGCGRVEELTLAAPLVLPERGGVRVQVAVDAPDAAGRRGVGVYSCPDGVGQAVWSQHAVGVLASGAADQVGGFGDGGVWPPQGAVSVDAEGCYELFADAGFGYGPVFQGLRAVWRRGEELFAEVALSDEVAESADTATGFGLHPALLDASLHASLLSSLEGQSADGGPALPFAWEGVSLFASGATALRVRLAPAGEHAVSVTAVDPTGAPVISIDALRTRRLTLDEVNASHTQLSDALFGVQWTTVPSTPAADHPSVAIIGTDPFGLADGLSDALPLVEERGDLAALAASEHPVPDLVLVPVAGTRRTGVPADAEGHTDAGTSDMLRSVREATAQVLEQIQQWLADDRFEAARLVFVTRGAVSVGEGGIADLAASAVWGLVRSAQSENPGCFGLLDLDLDLALDSDLAPEVDIERDRDRDPVGGTVQPALAAALHATADEPQLALRGGTVQAARLTRIPAPQTDRAETDPAETDRPEIDTRRPGTVLITGGTGGLGGLLARHLVAERGVRSLVLASRSGLAAEGAEKLVADLEALGAVVAVQTCDVADGDAVAALVAGVSDEYPLTAVVHTAGVLDDGVIGSLTEERLATVLRPKADAAWHLHEATRDLDLDAFVVFSSLAGVLGGAGQANYAAANTFLDALMAQRRAAGLPGVSLAWGPWDRAGGMTGTLSDAEADRLARSGVPPISAEQGLALYDAATAGERPLVVPVRLDLAALRGLGDVPALLRGLVRTPARRTAAAGAAPSADVLTRQLAGLGGAEQEEVLLRLVRGQAAVVLGHADGSAIGAGRQFQELGFDSLTAVEFRNRLNAATGLRLPATLLFDYPTPADVVGHLRGRLGTGEVSGAGSVLAALDNLEAVIAGLSLDDAGEHQLVAGRLEVLRAKWADMRSAEGAVDGGADVDIEEASDDDMFALLDDELGLN

SEQ ID NO: 8 - protein, 251 aa, Streptomyces noursei
MTTSTEESLWARCFHPAPAAPVRLFCFPHAGGSASFYFPVSAQLSSVAEVFAIQYPGRQDRRKEAGVSDLATLADQVYDALRPLLKERPSTFFGHSMGATLAFEVARRFEADDGDLVRLFASGRRAPSRVREEAVHRRSDDGIVEELKLLAGTNTALLGDEEILRMILPAIRSDYQAIETYRCPPDVTVRAPLTVLTGDRDPKTSLDEAEAWRGHTTGDFDLKVLPGGHFFVSSEAPAIIDLLRAHLAGNG

SEQ ID NO: 9 - protein, 966 aa, Streptomyces noursei
  MISC_FEATURE (1)..(1): Xaa is Met or Val-Met dipeptide
XRKQSGSSGLLTTLVGRDDELRTLARHAAAARDGRAGLVLLHGPAGMGKTSLLRSFTASDVCRGMTVLYGTCGETVAGAGYGGVRELLGGLGLSGGDARRSPLLEGLAARALPALTADPAGPDAATGAYPVLHGLYWLAARLMAQRPLVLVLDDVHWCDERSLAWIDFLLRRAEDLPLLVVLAWRSEAEPVAPAVLADIAAQRRPTVLGLHPLGPDDIGEMVRRVFRTTAAPSFVSRVAAVSGGNPLALARLLDELRAEGVRPDAAGERRAAEVGSHVLARSVRCLLERRPPWVRGVARAIAVLGPECTELLAALAGVPAATVDEALLVLRRAGILAADRVDFVHDVVRSAVLDDVAPPTLAELRTNAALLLSDAGRPSEELAGQLMLLPVLDQPWMAAVLRDAAAQAESRGAPEAGVRCLYRVLEVEPDNVAVRIQMARALAEINPPEAMRLLKEALSLAGDVRTRAQVAVQYGFTCLAVQESPSGVRMLEDALAELTAELGPEPGPVDRELRTLVESVLLIVGADEKVTIGAVRDRAARLTMPPGDTPAQRQMLAMTTVLTAMDGRDARSAVDQARRALRAPGVELEPWSLLSASFALSLADEVADAQYALDLMLQYGQDNAAVWTYVLALSTRALLHHGVGAFPEALADAQTAVEILGEERWADGAVLPRVALATALVDRGEPERAEHVLDGITRPRLERFVIEYHWYLQARAYARWVRGDFQGALDLLLACGRSLEESRFSNPAFVPWWADGAVLLATLDRHDQARELAAYGSELAERWGTARGLGLAFMAQGVAAPGRAGIDHLTEAVSLLADSPARAMEARAELLLGHAHLKRDDLRAAREHLRAAADLAQRCGAVKLGVDARKLLVTAGGRVRRMTASPLDMLTGMERTVADLAVTGASNRAIAEALFVTVRTIETHLTSVYRKLGVGGRAELSAVLETRTATSGRQPPAWVSQARGRA

SEQ ID NO: 10 - protein, 953 aa, Streptomyces noursei
  MISC_FEATURE (1)..(1): Xaa is Val or Met
XPRSKARNQPTTCTPQCAPDAHGDPTMLLECGREQRLIGDLLHRLGQGRPSVLSLTGRPGHAQNALVRWGACRARHDGLRVLRAQATPAERELRYGAVLQLLAVLDGPHGSTLDAAIRHDGPPPLPVPGIEEVLRRTGTAPTLVVVEDVQWLDPASLTWLQILLRHLGPDTPLAVLASSCGDTTAFDTDPKAPAVPGPPDTVPVARFVVPALTDRGVAATVRAVCGTPGDEEFIAALTSATAGNPAILRDALRAFVDHGLPADADHLPELHALTAGVVGDHTVRALDGLPAEVNAVLRALAVCGDLLDFHRVRALAGAHSLSEDRIRTLLASVGLTVSVGDKVHIRFPASKARVIEDMPAAERADLYVRAAELTHSCGVNDEDVAHLLLRSSPLGAPWVVPLLRRGFAAALRREDHHRACACLSRALQEPLDPRERSLLTLELAAAEAVARPEAGDRRLGELVRSTVADTDPTSSGEGVGVRAIDLGFARGNSEWVRRTAGEALPYAGPADREELVALFWLAAVRDDDAPMIPVVPRLPDRPVPPAQAGARAWQLATAGEDADKARKLARIALTGGVNESLMMPKLAACAALFATDDNDEAVHGLDTMLTAARSAHLRSMAARIFNLRARIHLCAARLEAAERDLDSAERALPPTSWHPRALPNLIATRILVSMETGRPDRARRLAEAPVPAGGEEGVWWPALLLARARVAADDGDWEEALRLSRECGRWLFRRHWANPAMLSWRPLAAEACLKLGDVTEARRLRDEELFFADRWGTASARGIARLTTRRLFDDDGDRAVRRIREAAALLRDSPARLAYLWSRLSQAGAETAHGDTAAAARSWQAVARMTAAHPASRLATAARTLTVPSVPVATAPPTAVVPPGWRDLSEAEKDTVLLAARGHGNRQIAEQLAVSRRTVELRLSNAYRKLRIGGRKELYLLLEALEGPVADAS

SEQ ID NO: 11 - protein, 927 aa, Streptomyces noursei
MLLERENELARIRAALDAAEAGDSSLLLINGPLGSGRSALLRRIPELAGDGTRVLRASAAWRERDFPFGIARQLFDHLLSGAGGAGPAERTAGAEHFSRLMDTGDRPTGTGPALEVSQAVLQGAQALLADASAERRLLILVDDLQWADGPSLRWLAHLTRRLHGLRALLVCTLADGDHRGRYPLVREVAGAAHTVLRLAPLSRDATRVLLAGPQGRPPQDALVRAVYEASRGNPLFLTAFRSALRATGRPPGGDHFGAVRELSPTVLRDRLAGHLRIQPQPVREVAVAVAALGDHSDPVLLAQLAGVDEIGFAGARRALVDAGLLARGRDVRFVHGVVRDAVDSLLTLDERERSHDDAADLLYRCGRPAEQVAGHLLAVVHPGRPWSEAVLRSAAHNALRAGRPADAARYLRRALLHHRTQDGCRARILVDLATAERALDPDACVRHVSQAVALLDTSRDRAAAVLRIPPSLLAAPSPSAVELVRQAAAGLDEPGQRDEEGADELALRLEAWLRHSGHENPVELASSVARLRRMGARPPVDSVAERELVAVLLSAGALSGRLSAAEIADTGNRILEREPATAAHAHTPLPLVMLSLFVAESVQGVASWLASEQHTRRRYATGADDVLLTAERAFVLVTQGRPAAAREHVERALVMDAGDWSEPAVMMFAAVAFELRDPALSERILERIRDRRPAGLALTATGQMLQAAVDVHFGRGRDALDTLLACGRRLETVGWRNSALLPWRPYAIGLHQRLGETDAALQLAEDELRWAREWGATTNLGRALRLKGWLLQDEGLDLLRESVEILRASSYATELARTLVVLGRRLPGGPEAEAVLREAAGIAAACGVPWLAERAELGLGSAIVPPVATLTPSERRVASLVSRGLTNQAIATELGVSSRAVEKHLTSAYRKLGVSGRRELVNALPGR

SEQ ID NO: 12 - protein, 210 aa, Streptomyces noursei
  MISC_FEATURE (1)..(1): Xaa is Val or Met
XISAQTAPAGESVGPGLMASLDRDLTIKHANQEFRRRFDDSAGDVCGRSFRDLMHPSVQQPLMRQFSRLIEGKRHRFASHVVAVGAQDAAFAGTLTASAVTGKTPDIAGILVLMDSSGAADAADAGVVTSQKKFLTEIDARILEGIAAGLSTIPLASRLYLSRQGVEYHVTGLLRKLRVPNRAALVSRAYSMGILNVGTWPPKVVDDFIK

SEQ ID NO: 13 - protein, 253 aa, Streptomyces noursei
  MISC_FEATURE (1)..(1): Xaa is Val or Met
XDAEGRRRDMLELIRRSGSADVVRLAEEFAVSKETVRRDLNVLEGHGLIRRRHGGAYPMVRPGSEAVFVSRTAQPIPEESRIATAAAELLSEAETVFIDEGFTPQLIADALPRDRPLTIVTASLPVVSAFATSPQANVLLLGGRVRRGTTATVDHWAVHMLSGFVIDLAFLGAEGISRRYGLTTPDPAVAEVKAQAIRVARRPVLAGVHTKFGTASFCRFGEVGDLETIVTGAGLPVAEAHRYHLMGPKVLRV

SEQ ID NO: 14 - protein, 354 aa, Streptomyces noursei
  MISC_FEATURE (1)..(1): Xaa is Val or Met
XAQDSGQTPRSLDHVDQALVHALQITPRASWTRIGSVLGLDAVTVARRWNRLVETGAAWISCHPAPVLAASGQGCLAFVEIDCAPGRLLDVARALAAAPHVVALSHVTGDRDLQLNVMARDPAMLSRWVTHDLAALDGVRAARTHLAGPVHTEGSRWRLRALGRHQVARLAADASRHRTDTPAFVLDELDQQLVTALSVDGRATYRALAEQCGAGPDTVRRRVQRLFAADMLHARCEVARPLSEWPVTVSFWGQVPAARLREVTRRVTGMREVRLCASVISRHNLHLVAWVRSLDDAQRFEVRLAERAADLTVTERAVALWHMKHGGHLLDEEGYRVGVTPLALWREPTDARRG

SEQ ID NO: 15 - protein, 398 aa, Streptomyces noursei
MQPELERLRRSLHREPELGLALPRTQEKVLAALDGLPLEITPGTGLTSVTAVLRGGRPGGAVLLRGDMDALPVTEESGVPYASEIPGRMHACGHDLHTAGLVGAARLLAERRERLHGDVVFMFQPGEEGHNGAGAMIEEGVLDAAGKPLDAAYALHVASNQVPGGVVITRSGTITSASDLLTVTVRGEGGHGSTPATAKDPVPAACEMVTAVQNWVTRAFDIFDPVVVTVGTFHAGTKASVIPDNRRVPGHGAQLFRIRPGPARRRELPRLVRAIAAAHGLEAEVDYLRHYPVTVNDTDETAFAVATARDLFAPGEVWESPIPTNGSEDFAYVLRRVPGAMLLVGAAPEGSDWQHAPMNHSPRAVFDDRVLYRQAALLTELAARRLAATAPAEPAVAG

SEQ ID NO: 16 - protein, 245 aa, Streptomyces noursei
  MISC_FEATURE (1)..(1): Xaa is Val or Met
XIELILPATVATEAAYDDRPRPGDRLLSSEREVIARAVESRQREFTTVRHLARRALRRLGHPDRAILPNRRGAPQWPPGIVGSMTHCAGYRAAAVSPAELSAAVSIDAEPNGPLPAGVLNAIALPSERPHLVALAAHRPDVHWDRLLFSAKESVFKAWYPLTQRELDFSEAEIVIDPTQGAFTARLLVPGPLLGGRRVTVFPGRWHSTPALLTTAVHLPAPTPRRDREHRTHLTVNSPLPRPTFG

SEQ ID NO: 17 - protein, 605 aa, Streptomyces noursei
MASPDDLEEERTAPRPARRLVGLLRPHRRSVALAVSMGVGGIVLNAFGPLLLGRVTDLIADGVLGGVPGPAPGIDFAAIGRLLLVLLALYVVASLFMLAQGRLVASAVWRTIHELRRDAREKLTRLPLRHFDRQPAGELLSRTTNDIDNLQQTLQQTLAELITSIFSLLTMLVLMLVISPSLAVVMLLSVPVSALIAARISKRAQPHYAAQWSANGTLNAHVEEVCTGHALIKGFDRRAAAEERFDACNDAVYRAAAKAQFASGAMEPVMMFVANLGYVLVAVIGAWKVINGTLTLGDVQAFILYARQFSQPIVEIASVAGRLQSGIASAQRVFTLLDAPEQAPDPLRPGTPARAEGRVEFTDVSFRYSPDTPLIENLSLTVEPGSTVAIVGPTGAGKTTLGNLLMRFYEPDSGRILLDGTDTATMTRDDLRSRFGLVLQDTWLFGGTIAENIAYGAPGACRADIEEAARATCADRFIRTLPQGYDTVLDDESGTVSAGEKQLLTVARAFLARPAVLVLDEATSSVDTRTEVLIQRAMNSLRAGRTSFVIAHRLSTIRDADLIVVMDAGRIVEQGTHDQLLCAQGLYARLHAARTHTPTAGAAAG

SEQ ID NO: 18 - protein, 584 aa, Streptomyces noursei
  MISC_FEATURE (1)..(1): Xaa is Val or Met
XLLRLLRAQLRPYAWATAALVALQLVQILGTLLLPTLGAALIDQGVVRGDGGRITELGVVMGVVALVQIAAALGAAALAARTATAMGRDLRSALFRRILDFSAREIGRFGTPSLLTRSVNDVQQVQNLAQTGFGIVVCAPLMCLGSVLLALRQDVPLALLLVALVLVVAVCFGLLLARMGTLYARMQLTLDRLGRLLREAITGVRVVRSFVRDDHERARFAQTNDAFLVVSRRVGRLIATMLPVVLLLMNGFTVALLWTGSHRIDAGRMPIGSLSALLSYLSLILMSVVMLAFVFLSVPRARVCAGRIAEVLDTGSSVAPPAAPQPVRGPAGRIELCAAGYRYPGAEEPVLRDVDLTVEPGERIAVLGSTGSGKTTLLNLVLRLADATEGAVRVGGTDVRELTAATLAAAVGFVPQRPYLFSGTVASNLRFGRPDATDEELWEALRVAQAADFVARMPDGLDAEITQGGGNVSGGQRQRLSLARALLRRPEIYLFDDCFSALDQATDAALRTALVPYTAGATVITVAQRISAGRDADRIVVLDRGRVVAQGTHDVLLRTSPTYREIALSQLTEEEAAHGLAGRP

SEQ ID NO: 19 - protein, 344 aa, Streptomyces noursei
MSKRALITGITGQDGSYLAEHLLSQGYQVWGLIRGQANPRKSRVSRLASELDFIDGDLMDQGSLVSAVDTVQPDEVYNLGAISFVPMSWQQAELVTEVNGMGVLRMLEAIRMVSGLSTSRTVSPRGQIRFYQASSSEMFGKAAETPQRETTLFHPRSPYGAAKAYGHYITRNYRESFGMYAVSGMLFNHESPRRGQEFVTRKISLAVARIKQGLQDKLALGNLDAVRDWGYAGDYVRAMHLMLQQDAGDDYVIGTGQMHSVRDAVRIAFEHVGLNWEDYVVIDPDLVRPAEVEVLCADSAKAQDRLGWKPDVDFPTLMRMMVDSDLAQVSRENQYGDVLLAANW

SEQ ID NO: 20 - protein, 7068 aa, Streptomyces noursei
MDNEQKLRDYLKLATADLRRTRRRVHKLESAAQEPVAIIGMTCRYPGGVRSPEDLWRMVEAGEHGVTPFPTDRGWDLEALAAAPTASGGFLHDAPDFDADFFGISPREAVAMDPQQRVVLESAWEAFERAGIDPTSVKGSRTGVFIGAMAQDYRVGPADGAEGFQLTGNTGSVLSGRISYTFGTVGPAVTVDTACSSSLVAVHLATQALRAGECTLALAGGVTIMSGPGTFIEMGRQGGLSADGRCRSFGDTADGTGWAEGVGILVLERLSDAVRNGHEILAVVRGTAVNQDGASNGLTAPNGPSQQQVIQQALVNARLAAGDIDVVEAHGTGTTLGDPVEAQALLATYGQNRPADRPLLLGSVKSNLSHTQAAAGVAGVIKMVMAMRHGTLPRTLHAEEPTHHVDWSQGAVRLLTDTTDWPATGAPRRAAVSSFGISGTNAHTIIEQAPEPQPEDAATAQDDAAGSTPATAPVVPGVVPVLLSGRTPDALRGQAAALRAALDTGRRPDLLDLAHSLATTRAGFEHRAVLLATDHPALTDGLTALADADDPAAAPAWITGTTRAETRLAVLFTGQGAQRLGAGRELAARFPAFATALDAALDAFTPHLDRPLREVLWGTDAALLDRTAYAQPALFAVEVALYRLIESFGVRPDHLAGHSVGEIVAAHLAGVLSLADAATLVAARGRLMQALPDGGAMIAVQASEADVAPLLAGHEDQVAIAAVNGPSAVVLSGAEATVTALAEQLAADGRKTRRLRVSHAFHSPLMEPMLDAFRAVVEDLTLQPPLLPVVSNLTGKPATVAQLTSADYWVDHVRHAVRFADGIDWLARHDTTAFLELGPDGVLSAMAQDCLDAADADAVTLPALRAGRPEEHTLTTALAGLHVHGATLDWTGCFAGTGARRTDLPTYAFQRRRYWPKALQSGTADLRSVGLGAAHHPLLSAAVSLADAGGTLLTGRLSRQTHPWLADHTVRGTTLLPGTAFLELAVRAGDEVGCDRVEELTLAAPLLLPEQGGVQVQLWIGNPDVSGRRTVNVHARPDTGDDTPWTAHATGVLTTADASRQLPASSEQGGTPLAGDPHPALDAAQWPPAGAEPLPLDGHYDRLADGGFGYGPVFQGLRAAWRGGDVVYAEVELPEAGRSDAEAFGLHPALLDAALHAAPFTGLGERGRGGLPFSWEGVSLHAGGATTLRVRLTPVADDALALTVADGTGAPVLSVDSLVLRSVATQQLDTAAAVARDALFRLDWTPVQPTATDPGPVALLGADPFGLLTHAGFADAPAYPDLAALAAADGPVPTTVVLSLAGTGDDAADPARSAHRCAAEALAAVQTWLDHHERFAAARLVFVTRGATVGRDVAAAAVWGLVRSAQSENPGCFALVDLDPDGAVGAAALVAALVSGEPQLAVRGDVLRVARLVRRPLTEVGAGADGTGDGVGDGSGVSFSGEGAVLVTGGTGGLGAVLARHLVAEYGVRDLLLVSRSGERAVGAGELVAELAGVGARVRVVACDVTDRAAVVELVGGHAVSAVVHAAGVLDDGMVGALTGERLSAVLRPKVDAVWHLHEATRGLDLDAFVVFSSLAGVFGSPGQANYAAANAFLDALMTRRRAEGLPGLSLAWGPWEQSGGMTGTLTDVDAERLARSGVPPLSVAQGLALFDAAVAGTDATCVPVRLDLPVLRARGEVPPLLRSLIRVRARRAAVAGSATAGNLAQRLRRLDEDGRDEMVLDLVRGQVALVLGHATGGDVDAGRAFRDLGFDSLTAVELRNRLNTVTGLRLPATLVFDYPTVRHLATYVLDELLGTDAEVATVQPAAVAVADDPIVIVGMACRYPGGVSSPEDLWRVLTEGTDAVSGFPTNRGWDVESLYHPDPDHPGTSYTRSGGFLHEAGEFDPGFFGMSPREALATDSQQRLLLESSWEAIERAGIDPVSLRGSRTGVFAGVMYSDYSAMLASPEFEGFQGSGSSPSLASGRVAYTLGLEGPAVTVDTACSSSLVAMHWAMQALRSGECGLALAGGVTVMSTPAVFVDFARQRGLSPDGRCKAFADAADGVGWSEGVGVLVLERQSDAVRNGHEILAVVRGSAVNQDGASNGLTAPNGPSQQRVIRQALASGGLTAGDVDVVEAHGTGTTLGDPIEAQALLATYGRDREPERPLLLGSVKSNLGHTQAAAGVAGVIKMVLAMRHGVVPRTLHVDAPSSHVDWSEGAVELLSEQAAWPETGRVRRAGVSSFGISGTNVHVIVEQAPGAKAIAAAGAARRTPGAVPVLLSGRGRSALRGQAARLLGHLQARPDAELVDVALSLATTRSRFEQRAAVVAQDRDQLIASLGALAADRPDPAVVEGEAAGRGRTAVLFTGQGSQRAAMGRELHEVQPEFAAAFDAVCAVFDPLLDRPLREVVFAEDGSDEAALLDETGWTQPALFAVEVALFRLVESWGVRPDFVAGHSIGEIAAAHVAGVLTLEDACRLVAARATLMQALPTGGAMIAIQATEDEIAAHLDDTVAIAAVNGPQSVVISGDEEAAETIAATFAERGRKTKRLRVSHAFHSPRMDGMLDAFRIVAEGLTYRAPRIPLVSDLTGRRADDAEVCTAEYWVRHVREAVRFADCVRTLRDAGATTFLELGSDGLLTAMAEDTLGDDHDAELVPMLRAGRAEELAAATALARLQVRGVDVDWAAYLAGTGARRTDLPTYAFQHAYYWPQLPTPAAALAAADPADQQLWAAVERGDARELADILGLGEQDLTPLDSLLPALTSWRRGNQEKHLLDTLRYRVEWTRLSKPTAPVLDGTWLLVASDATAADQPALLDGLADALGSHGARVRRLLLDDSCADRAVLAERLARTADVDAATQVLSVLPLDERDADDCPPLTRGLALTVALVQALADTGAQGRLWTATRGAVSTNPADPVTHPVQAAAWGLGRGVALEHPRLWGGLVDLPQVFDERAGQRLAGILAVKDAPDGEDQVALRATGVSGRRLVRHTVEALPTAAEFTATGTVLITGGTGGLGAEVARWLARAGAQHLVLTSRRGPDAPGAAELRAELEGYGPSVSVVACDVADRDALAAVLTALPEELPLTGVVHTAGVGHYGPLDTLSTAEFAGLTAAKLAGAAHLDALLADRELDFFVLFGSIAGVWGSGNQSAYGAANAYLDALALHRRARGLAATSVAWGPWAEAGMAADDAVSETLRRQGLGLLDPAPAMTELRRAVVRQDVTVTVADVDWQRYAPLFTSARPSALIAGLPEVRALAADERTEQDATGASEVVTRVRALAEPEQLRLLTDLVRTESATVLGHSSADAVPEGRAFRDVGFDSLTAVELRKRLGAATGLSLPSTMVFDYPTPLELAQYLRAEILGAVLEVAGPVATGGADDEPIAIIGMACRFPGGVSSPEQLWDLVASGTDAISEFPVNRGWQTGHLFDPDPDRPGTTYSTQGGFLHEADEFDPTFFGISPREALVMDPQQRLLLETTWESFERAGIRPETLRSTLTGTFVGSSYQEYGLGAGDGTEGHMVTGSSPSVLSGRLSYVFGLEGPAVTVDTACSSSLVALHLACQSLRNGESNLAVAGGATIMTTPNPFIAFSRQRALAKDGRCKAFSDDADGMTLAEGVGVVLVERLSDAQRNGHPVLAVLRGSAINQDGASNGLTAPNGPSQQRVIRQALANARLAPGDIDALEAHGTGTPLGDPIEAQALFATYGRDRDPESALLLGSVKSNIGHTQSAAGIASVIKMVMALRHSELPPTLHADAPSSHVDWSAGTVRLLTQARAWPETGRPRRAAVSSFGISGTNAHVLLEQAPVADTPAEERPAVAPVPIAAGVVPWVVTARSAAALRGQAERLLAHAETVGTALPAAGPLDIGLSLVSARARFEHRAVVVPPAGTDPLAALRAVATDGPSPVVARGVADVEGRTVFVFPGQGSQWVGMGSQLLDESAVFAERIAECAAALAEFTDWSLVDVLRGVVGAPSLERVDVVQPASFAVMVSLAALWRSRGVLPDAVVGHSQGEIAAAVVSGALSLRDGARVVALRSQAIGRALAGRGGMMSVALSVDVLEPRLVEFEGRVSVAAVNGPRSVVVAGEPEALDALHARLTADDIRARRIAVDYASHSHQVEDLHEELLEVLAELAPRTSEVPFFSTVTGDWLDTARMDAGYWFRNLRGRVRFADAVADLLAAEYRAFVEVSSHPVLSMAVQEAIDEAGVPAVAAGTLRRDQGGTDRFLLSAAEVFVRGVDVDWAGLFEGTGASRIDLPTYAFQHEHLWAVPPAPEAVAAADPDDAAFWTAVEDGDVSALTAALGTDEDSVAAVLPALTSWRRARRDRSTVDAWRYRVAWKPLGGTLPHPSLTGTWLLVTADGIDDTDVAGALETYGAEVRRLVLDEECVDRAVLRERLAGAEDVTGIVSVLAAAERTDAVPGTSLVLGTALTVALIQALGDAEIDAPVWALTRGAVSTGRADELTAPVQAQVTGIGWTAALEHPQRWGGTLDLPAALDARAAQRLAAVLSGALGSDDQLAIRPSGVFTRRIVRAEATAGRPAGTWTPRGTTLVTGGSGTLAPHLARWLAQRGAEHLVLISRRGTAAPGAAELVAELAESGTEATVAACDITDRDAVAALLADLKADGRTVRTVVHTAATIELHTLDATTLADFDRVLHAKVTGAQVLAELLDDEELDDFVLYSSTAGMWGSGAHAAYVAGNAYLAALAEHRRANGLPALSLSWGIWADDLKLGRVDPQMIRRSGLEFMDPQLALSGLQRALDDNENVLAVADVDWETYHPVYTSGRPTPLFDEVPEVRRLTAAAEQSAGTVAEGEFAAALRALSDAEQQRTLLETVRTEAASVLGLSSAEDLTDQRAFRDVGFDSLTAVGLRNRLASVTGLTLPSTMVFDYPNPAALAAYLHGELAGARSAAAGAAAVPTGAPDADDPIAIVGMSCRYPGGVGSAEDLWRIALDEVDAISGFPADRGWDAEGLYDPDPDRPGRTYSVQGGFLRDVAEFDPGFFGISPREALSMDPQQRLLLETAWEAFEHAGIDPVGQRGSRTGTFVGASYQDYASGVPNSEGSEGHMITGTLSSVLSGRVSYLFGFEGPAVTLDTACSSSLVAMHLACQSLRNGESSLALAGGVSIMSTPMSFVGFSRQRALAEDGRCKAYADGADGMTLAEGVGLVLLERLSDARANGHQVLAVIRGSAVNQDGASNGLTAPNGPSQQRVIRQALANSAVAPGDIDVLEGHGTGTALGDPIEAQALLATYGQDRAPERPLLLGSVKSNIGHTQMASGVASVIKLVRALQEGVVPKSLHIDRPSTHVDWSSGAIGLLTERTPWPETGRPRRAAVSSFGISGTNVHTILEQAPADEAPTPADPPRDGLVPVLLSGRGEAALRAQAARLLAFVEERPEAHLTDLAHSLATSRAALERRAAVIAADRDTLTRGLRALSDGRPDPGLVQGTAGRGRTAFLFTGQGSQRPGMGRELHDRYPVFADALDEVLARLDDGPDRPLREVLFAAPDSAEAALLDRTGYAQPALFAVEVALFRLLTSWGLTPDYLAGHSVGELAAAHVAGVLSLDDACTLVAARGRLMQALPEGGAMVALEAAEDEVLPLLEGLTDRVSVAAVNGPRSVVVAGVEEDVLLLADLFAADGRRTKRLRVSHAFHSPLMDAMLDDFAAVARGLTYHPPTIPFVSNVSGGLATAEQVRTPDYWVGHVRAAVRFADGIDWLATQGDVHTFLELGPDGVLSAMARESLTDPSRTALLPTLRGDRPEEPALVTAVAAAHAHGARVDWSGYFADHGARRTTLPTYAFQRERYWPDTTAATSAHTPGSALDAEFWAAVERDDVAALAASLDLDDATVTAMVPALTAWRRRRGEQTELDSWRYRVTWKPRGGATAPAALTGRWLVLVPHDHQDRQDDATAAWAADVETALGTTTVRLTVTTTDRAALAARITEAAGDQGPFSGVLSLLPLATGDAGHPGAPAALTLTTTAVQALGDAGIDAPLWNVTRGAVAVGRAEQVTAPEQAAVWGLGRAVALELPARFGGTLDLPATLDGQAARRLRAVLAATDGEDAVALRPSGVFLRRLAHAPAGPDTARTAFDPAAGTVLITGGTGGIGGHVARRLARDGATHLLLTSRRGPAAPGADALRAELEELGARVTLAACDAADRDALAALLAELPDDAPLCAVFHTAGVVEDHVVDALTPENFAAVLRAKTVAAHHLHELTADLDLAAFVLFSSTAGVLGAAGQGNYAAANAHLDALAEHRRSHGLTALSVAWGPWAGSGMVADAAELTDRVRRGGFEPLAPEPAVRALLRAIENDDTTVALADIDWERFQRAFAAVRPLPFVADLPETGRATPATATGAATGLRQQLAELPEHERPAAVLDLLRTQVAAVLGHADPRTVEDDHAFRDLGFDSLTILELRNALNAATGLSLPATLVYDLPTPREMADFLLAELLGTLPTDTAATVASTASPKLSASFEQGGTPFDDPIAVIGIGCRFPGGVTTPEELWQLLDEGRDGISRFPDDRGWDLAALGAGASDTLEGGFLTGVADFDARFFGISPREALAMDPQQRLLLETTWEALERAGIDPTTLRGSTTGVFVGTNGQDYPTLLRRSASDVAGYVATGNTASVMSGRLSYALGLEGPAVTIDTACSSSLVALHWAGRALRAGECDLVVAGGVSVMASPDSFVEFSTQGGLAPDGRCKAFSDAADGTAWSEGVGILVLERLSAARRNGHQVLGLIRGTAVNQDGASNGLTAPNGLSQQRVIAQALADARLRPADIDAIEAHGTGTTLGDPIEARALITAYGRDRDAERPLLLGTVKSNIGHTQAAAGAAGVIKMLMAMRHGTLPRTLHVGTPSSHVDWSGGTVALLDDARPWPRTGQPRRAGVSAFGVSGTNAHVVVEQAPETEAPAAPAAEPAPEATPTVVPWVVSGRSREALQAQLDRLTAHTAAHPARSAADVGRSLATDRTLFPHRAVLLAGPDGVREAARAAAPRTPGRTAFLFSGQGAQHALMGHDLYQRFPVYADALDTVLAQFDTVLDVPLRAALFAAPGTPEAALLDQTGFTQPALFAVEVALFRLAESWRLTPDFVAGHSIGEI

SEQ ID NO: 21 - protein, 7 aa, Artificial
  Homologous to Polyketide Synthase
  MISC_FEATURE (1)..(1): Xaa is Asp or Glu
  MISC_FEATURE (4)..(4): Xaa is Phe, Leu or Val
XLGXDSL

SEQ ID NO: 22 - DNA, 21 bp, Artificial
  Oligonucleotide primer
  misc_feature (3)..(3): n is g or c
  misc_feature (6)..(6): n is g or c
  misc_feature (9)..(9): n is c or g
  misc_feature (10)..(10): n is t or c
  misc_feature (12)..(12): n is g or c
  misc_feature (18)..(18): n is c or g
  misc_feature (21)..(21): n is g or c
ganctnggnntngactcnctn

SEQ ID NO: 23 - protein, 7 aa, Artificial
  Homologous to Polyketide Synthase
VDTACSS

SEQ ID NO: 24 - DNA, 21 bp, Artificial
  Oligonucleotide Primer
  misc_feature (1)..(1): n is g or c
  misc_feature (4)..(4): n is g or c
  misc_feature (7)..(7): n is g or a
  misc_feature (10)..(10): n is g or c
  misc_feature (13)..(13): n is c or g
  misc_feature (19)..(19): n is g or c
ngangancangcngtgtcnac

SEQ ID NO: 25 - DNA, 26 bp, Artificial
  Oligonucleotide Primer
gttggtaccccactcccggtccgcac

SEQ ID NO: 26 - DNA, 18 bp, Artificial
  Oligonucleotide Primer
ccagccgcatgcaccacc

SEQ ID NO: 27 - DNA, 19 bp, Artificial
  Oligonucleotide Primer
ccgcgtcggatccgccgac

SEQ ID NO: 28 - DNA, 19 bp, Artificial
  Oligonucleotide Primer
agccttcgaattcggcgcc

SEQ ID NO: 29 - DNA, 2700 bp, Streptomyces noursei
gatccgccgacgacaccggccgccgcaccgtcaccgtccacgcccgccccgacgacaccgccgaccgcacctggacgctgcacgccaccggtgtgctcgccaccacgccaccggccgccgcggcgttcgacaccacggtctggccgcccgccgacgccgaacccctcaccaccgacgactgctacgcacacttcaccacccaccgcttcgcctacggccccgccttccagggcctgcgggccgcctggcgcgccggcgacgtgctgtacgccgaggtcgccctgccggagtccgccaccgacgaagcggccgccttcggcctgcacccggcgctcctggacgccggcctgcacgccgcgctcctcgccgacgaccgcgacaccggactcccgttctcctgggaaggcgtcactctgcacgcctccggcgccaccgcgctacgcgtccggctcgccccgaacggccccaacggcctgtccgtcaccgccgccgacccggccggcaaccccgtcgccaccgtcacccgcctgctcgcccgccccctggacgccgagcagttgaccatccacagcgccctgacccgcgacgcgctcttccacctggactggaccccggtcccgcttcccgacaccgccaactccgcgccgccggccctcctcggcccggacaccgccgtgctcgccgacgccctcggcgacccggccgtcgcacgccacgcaaccctcgacgacctcctggccggggacaccaccccgcccgccacggtcctcgtccccctcggcgccccactcgacggcgacaccgcgcagcacgcgcacgccctcacccgcagcgcgctgaccctcgtccagcagtggctcgccaccgaccgcctcgccgactcccgcctggtcttcgtcacccacggagccgtcgccaccgacgacgcgccccccaccgacctggccgccgccgcggtctggggcctgatccgctccgcgcagaccgagaaccccggcaccttcaccctcctcgacctcgacaccgagcccgactcgaccaccgcgctcagccgcgccctgaccctcgacgaaccacagctcctcctccgcgccggccgcgcccgcgccgcccgcctcacccgcacccccgcccccaccaccaccacccacacgccgtggtccgcggacggaacggtgttggtgacgggtggtacgggtggtctgggtgggttggtggcccggcatctggtgcggtcgtgtggggtgcggcatttgttgttgaccagtcgttctggtgtgggtgctgcgggtgcggccgggttggtcgcggagttggagtcgttgggcgcgcgggttgtggttgcggcgtgtgatgtgggtgatggctcggctgttgcggagttggttgccggtgtgtcggagtcgtatccgttgtctgcggtggtgcatgcggctggtgtgttggatgacggtgtggtgggttcgttgacgccggagcggttggctgcggtgttgcgtccgaaggtggatggtgcgtggaacctgcatgaggcgacgcgtggtctggatctggacgcgtttgttgtcttctcgtctgttgcgggtgtgttcgggggtgcgggtcaggccaactatgcggcgggtaatgcgtttttggacgcgttgatggttcatcgggtggctggtgggttgcctggtgtgtcgttggcgtggggtgcttgggatcagggtgtggggatgacggcggggctgacggagcgggatgtccgtcgtgctgctgagtcgggtatgccgttgttgacggttgatcagggtgtggcgttgttcgatgcggcgttggcgacggggagtgccgcgttggtgccggtccgtctggacctggccgcactgcgcacccggggcgacatcgcaccgctcctccgcggcctggtcaaggcgcccatccgccgcgcagccgccaccacacccggcgacaccggactcgccgagcagctcacccggctccagcgcgccgagcgacgggacaccctcctcgcgctcgtccgcgaccaggccgcgatggtcctcggccacacctcgggcgacggcgtcgacccgtcccgcgccttccgcgacctcggcttcgactcgctcaccgcggtcgaactccgcaaccgcatcggcgcggccaccggcctgcggctaccggccacggccgtcttcgactaccccaccgccgatgccctcgccgcacacctgctcaccgaactgctcggccccgacgccgagtcggaccccgacgagcccggcgaccccaccgcgggaccgaccgacgaccccatcgtcatcatcggcatgagctgccgcttccccggcgacatcggctcgccggaggacctgtggcgcctgctcggcgacggcgccgacgtcgtcaccgacttcccgaccaaccgcggctgggacctggacaacctctacgaccccgaccccgcgcacgccggcacctcgtacgcccgcaccggcggtttcctgcacgacgccgccgacttcgacgccgacttcttcggcatgagcccccgcgaggccatggccacggactcccagcagcgcctgctgttggagtcctcgtgggaggcgatcgagcgggccggcatcgacccgctgaccctgcgcgacagccgcaccggcgtcttcgccggcgtcatgtacagcggctacggcacccgcctcgacggcgccg

SEQ ID NO: 30 - protein, 899 aa, Streptomyces noursei
SADDTGRRTVTVHARPDDTADRTWTLHATGVLATTPPAAAAFDTTVWPPADAEPLTTDDCYAHFTTHRFAYGPAFQGLRAAWRAGDVLYAEVALPESATDEAAAFGLHPALLDAGLHAALLADDRDTGLPFSWEGVTLHASGATALRVRLAPNGPNGLSVTAADPAGNPVATVTRLLARPLDAEQLTIHSALTRDALFHLDWTPVPLPDTANSAPPALLGPDTAVLADALGDPAVARHATLDDLLAGDTTPPATVLVPLGAPLDGDTAQHAHALTRSALTLVQQWLATDRLADSRLVFVTHGAVATDDAPPTDLAAAAVWGLIRSAQTENPGTFTLLDLDTEPDSTTALSRALTLDEPQLLLRAGRARAARLTRTPAPTTTTHTPWSADGTVLVTGGTGGLGGLVARHLVRSCGVRHLLLTSRSGVGAAGAAGLVAELESLGARVVVAACDVGDGSAVAELVAGVSESYPLSAVVHAAGVLDDGVVGSLTPERLAAVLRPKVDGAWNLHEATRGLDLDAFVVFSSVAGVFGGAGQANYAAGNAFLDALMVHRVAGGLPGVSLAWGAWDQGVGMTAGLTERDVRRAAESGMPLLTVDQGVALFDAALATGSAALVPVRLDLAALRTRGDIAPLLRGLVKAPIRRAAATTPGDTGLAEQLTRLQRAERRDTLLALVRDQAAMVLGHTSGDGVDPSRAFRDLGFDSLTAVELRNRIGAATGLRLPATAVFDYPTADALAAHLLTELLGPDAESDPDEPGDPTAGPTDDPIVIIGMSCRFPGDIGSPEDLWRLLGDGADVVTDFPTNRGWDLDNLYDPDPAHAGTSYARTGGFLHDAADFDADFFGMSPREAMATDSQQRLLLESSWEAIERAGIDPLTLRDSRTGVFAGVMYSGYGTRLDGA

SEQ ID NO: 31 - DNA, 26 bp, Artificial
  Oligonucleotide Primer
cgccgcatgctgttctcaccccacgt

SEQ ID NO: 32 - DNA, 20 bp, Artificial
  Oligonucleotide Primer
ggcgcgacccggttcggcct

SEQ ID NO: 33 - DNA, 28 bp, Artificial
  Oligonucleotide Primer
gcgagcggccgcttcaccccgcaactca

SEQ ID NO: 34 - DNA, 28 bp, Artificial
  Oligonucleotide Primer
cgcgaagcttggccgactgctcgacgtc

SEQ ID NO: 35 - DNA, 125401 bp, Streptomyces noursei
gaattcggatcgatgctgctcgtggtgtgtgccgcgggaggtgccgacggtgccgtgcgtgaatcggggcgtggtcgccgtcgcgatcgcggtggtgtcggtgctgctcgtgctgaccgtggtggtggcgacggcctacttgccgtgagcccggtccttgcgccgcgacctgggcagcggatgcacctcttcggtcgacgccaaggggcggtggcgcaggtcgagataggcgcggacggagacgccgggctgccccggcgtctgccagggcgcggaggggccgctggaacgccacagacggcccagctcggccgcggcaagggtggcggtggcttcgtcggcggcggtgacgtcgatgacgaccatgccgggttcgctgacatgttcctcgtggatatgcacagttctgtatgacctatttcgccccgtggcgtaaggagtagccggcaggtttcatccgaaggtggggcgcgggagcggcgagttgaccgtgaggtgcgtgcggtgttcccggtcgcgccggggggtgggggccggcaggtggaccgccgtggtcagcagggcgggggtgctgtgccagcggccggggaagaccgtgacccggcgaccgcccagcagggggcccgggaccaggagtcgggcggtgaaggcgccctgtgtcgggtcgatgacgatctcggcctcggagaagtccagttcgcgctgggtcaggggataccacgccttgaagacgctctccttggcgctgaagagcagccggtcccagtggacgtccggacgatgggccgccagggccacgaggtgcggccgttccgagggcagggcgatggcgttcaggacgccggccggcagcggaccgttcggttcggcgtcgatgctcaccgcggccgacagctccgcgggggagacggcggcggcgcggtagccggcgcagtgcgtcatgctgccgacgatgcccggcggccactgcggggcgccgcgccgattgggcagtatggcccggtccgggtggccgagccggcgcagggcccggcgggcgagatggcggacggtggtgaactcgcgctgccgggactccacggcccgggcgatgacctcgcgttccgaggagagcagccggtcgccggggcgcggccggtcgtcgtacgccgcctcggtggcgaccgtggcgggcaggatcagttcgatcaccgcatacctccggcgaacggtaagaacagggggttgcttcggggcacggttccgtccttgacggggcgccgtgggcggccgggtcagccggccgcggcgcccgcggtgggagtgtgggtgcgggctgcgtgcagccgggcgtacaggccctgcgcgcacaggagttgatcgtgggtgccctgctcgacgatgcggccggcgtccatcacgacgatcaggtccgcgtcgcggatcgtggacaggcggtgcgcgatcacgaagctggtccggcccgcccgcagggagttcatggcgcgttggatcaggacctcggtccgggtgtccacggagctggtggcctcgtccagcacgaggacggccggtctggcgaggaaggcccgggccacggtcagcagctgcttctcgccggcgctgacggtgcccgactcgtcgtccagcacggtgtcgtagccctgcggcagggtgcggatgaagcggtcggcacaggtcgcgcgggccgcctcctcgatgtccgcacggcaggcaccgggtgcgccgtacgcgatgttctccgcgatggtgccgccgaacagccaggtgtcctggagcaccagcccgaagcgggaccgcaggtcgtcgcgggtcatcgtcgcggtgtcggtgccgtccaggaggatgcggccggagtccggttcgtagaagcgcatcaggaggttgccgagggtggttttgccggcgccggtggggccgacgatcgccacggtgctgcccggttccacggtcagcgagaggttctcgatgaggggcgtgtcgggggagtagcggaaggacacgtcggtgaactcgacgcggccctcggcgcgggcgggcgtgccgggccggagcgggtccggggcctgctcgggggcgtcgagcagggtgaagacgcgctgggcggaggcgatgccggactggagccggcccgccaccgaggcgatctccacgatcggctggctgaactggcgggcgtagaggatgaacgcctgcacgtcaccgagggtcagggtgccgtttatgaccttccaggcgccgatgacggccaccagcacatagccgaggttggcgacgaacatcatgaccggttccatggcaccggaggcgaactgcgccttggccgcagcccggtagaccgcgtcgttgcaggcgtcgaagcgctcctcggccgccgcgcgccggtcgaagcccttgatcagcgcatgaccggtgcacacctcctccacatgggcgttgagggtgccgttcgcggaccactgcgcggcgtagtggggctgcgcgcgcttgctgatccgggccgcgatcaacgccgagaccggcacgctgagcagcatcaccacggccagcgacggcgagatcaccagcatcagcaccagcatcgtcaacagcgagaagatcgaggtgatcagctcggcgagggtctgctggagggtctgttggaggttgtcgatgtcgttggtggtgcggctgagcagctcaccggccggctgccggtcgaagtggcgcagcggcagccgggtcagcttctcccgggcgtcgcggcgcagttcgtggatggtgcgccacaccgcggacgccaccagccggccctgcgccagcatgaacagcgacgccacgacgtagagcgccagcaggaccagcagcagccggccgatcgcggcgaagtcgatcccgggcgccgggcccgggacgccgccgagcacgccgtcggcgatcagatcggtgacccggccgagcagcagcgggccgaacgcgttgagcacgatcccgccgacgcccatcgacacggcgagtgccacggagcggcggtgcggacgcagcaggccgacgagccgacgtgccggccggggcgcggtccgctcctcctcaaggtcgtccggcgaggccatgggcggcttcctcctcggtcagctgcgagagcgcgatctcgcggtaggtcgggctggtgcgcagcagcacgtcgtgggtgccctgggcgaccacgcgcccgcggtccagcaccacgatccggtccgcgtcgcggccggcggagatccgctgcgccacggtgatcaccgtggcgcccgcggtgtacggcaccagcgcggtccgcagcgccgcatcggtggcctggtcgagcgccgagaaacagtcgtcgaagagatagatctccggccggcgcagcaacgcccgggcgagggacaggcgttggcgctggccgccggagacattgccgccgccctgggtgatctccgcgtcgaggccgtccggcatccgcgccacgaagtcggccgcctgggcgacccgcagcgcctcccacagctcctcgtcggtggcgtccggccgcccgaagcgcagattgctcgccacggtgccggagaacaggtacggccgctgcggcacgaacccgacggcggcggcgagcgtggccgcggtcagctcgcggacgtcggtgccgccgacccgcaccgcgccctcggtggcgtcggccagccgcagcaccaagttcaacagggtcgtcttgccgctgccggtgctgccgagcacggcgatccgctcgcccggctcgacggtcaggtcgacgtcccgcagcacgggctcctcggcgcccgggtagcggtacccggccgcgcacagttcgatccggccggcgggcccgcgcaccggctgcggcgcggccggcggcgccacgctcgacccggtgtccaggacctccgcgatccggccggcacagacccgggcccgcggcaccgacaggaacacgaaggcgagcatcacgacggacatcaggatcagcgagagatagctcaggagggcgctgagcgagccgatcggcatccggcccgcgtcgatccggtgggagccggtccacagcagggctacggtgaaaccgttcatcagcagcagcacgaccggcagcatcgtcgcgatcagccgacccacccgccgcgacaccacgaggaacgcgtcgttggtctgcgcgaaccgcgcgcgctcgtggtcgtcgcggacgaaggaccggaccacccgcaccccggtgatcgcctcgcgcagcagccgccccagccggtccagggtcagctgcatccgcgcgtacagggtgcccatccgggccagcagcaggccgaagcagaccgccaccaccagcaccagcgccaccagcagcagtgccagcggaacgtcctggcgcagcgccagcagcacgctgcccaggcacatcagcggcgcgcagacgacgatgccgaagccggtctgggcgaggttctgcacctgctgcacgtcgttcaccgaccgggtcagcagggagggggtgccgaaccggccgatctcgcgggcggagaagtccaggatgcggcggaagagcgcggaccgcagatcgcggcccatcgccgtcgcggtccgggcggccagcgcggccgcaccgagcgcggcggcgatctgcaccagcgccaccacgcccatcaccacacccagctcggtgatgcgcccgccgtcgccgcgcaccaccccctggtcgataagtgcggcgcccagcgtcggcagcagcaaagtgcccaggatctggacgagttgaagggcgacgagagcggcggtggcccaggcgtaggggcgcagctgtgcccgcagaagtctcaacagcacggaggaacaccccggttgacggcggcgtgcggccgcgcggtggacggagtcggccggcccgccgacccggtcattgcaccgcagtccgctccgaaatttcactagtgttgggggtggcaacggacttttgacggcccggtactcgtgaattccctagaaagcccgggatgcgttgacagcatcttccgcggcttgcgagcgtgcgggtgtctatcgtccggactgcgtattcgacgccaggtcgtggccgagctcaagcgtttggacggtctctttcgtgttcgagaagggtttgccatgtccaaacgagcgctgatcaccggaatcaccggccaggacggctcctatctcgcggagcacctgctgtcccagggctaccaggtgtggggtctgatccgcggccaggccaatccccgcaagtcccgggtcagccgcctcgcctccgaactcgacttcatcgacggggacctgatggaccagggcagcctggtctccgccgtcgacaccgtgcagcccgacgaggtctacaacctcggcgccatctcgttcgtgccgatgtcctggcagcaggccgagctggtcaccgaggtcaacggcatgggcgtgctgcgcatgctggaagccatccgcatggtcagcggactgtccacctcccgcacggtcagcccgcgcggccagatccgcttctaccaggcgtccagctcggagatgttcggcaaggccgccgagacgccgcagcgcgagaccaccctcttccacccgcgcagcccctacggcgcggcaaaggcgtacgggcactacatcacccgcaactaccgcgagtccttcggcatgtacgcggtctccggcatgctcttcaaccacgaatccccgcgccgcggccaggaattcgtcacccgcaagatcagcctggcggtcgcccgcatcaagcaaggcctccaggacaagctggcactcggcaacctcgacgcggtgcgcgactggggctatgccggcgactacgtccgcgccatgcacctgatgctccagcaggacgccggcgacgactacgtcatcggcaccgggcagatgcactcggtgcgcgacgcggttcggatcgcgttcgaacacgtcggcctgaactgggaggactacgtcgtcatcgaccccgacctggtgcggcccgccgaggtcgaggtgctgtgcgccgacagcgccaaggcccaggaccgcctcggctggaagccggacgtcgacttccccaccctcatgcgcatgatggtcgattccgacctggcgcaggtttcccgcgaaaaccaatacggcgacgtgctgctcgccgccaactggtagcagttctcaagctttcgaaaactagtgaattcctgccggaattccgacgacactcgccacatggattcccccggtgagtggcgaatccaggtggcgaatccgaacgtaccgccgaaacggcgtggagaagtcggacgccattcacgtgcggccgtcggctgtcgagatgggttgagttgagatggacaacgaacaaaaactccgggattacctcaagcttgcgacggccgaccttcgacgcacccggcggcgcgtccacaagctggagtcggcggcccaggaaccggtggccatcatcggcatgacctgtcgctaccccggcggcgtccgcagccccgaagacctctggcgcatggtcgaggccggcgagcacggcgtcaccccgttccccaccgaccgcggttgggacctggaggcgctggccgccgcgccgaccgcctccggcggattcctgcacgacgcacccgacttcgacgcggacttcttcggcatctcgccgcgcgaggcggtcgccatggacccgcaacagcgcgtcgtcctggaatccgcctgggaggcgttcgaacgcgccggcatcgacccgacgtccgtgaagggcagccgcaccggagtcttcatcggcgcgatggcccaggactaccgggtcggccccgccgacggcgccgagggcttccaactcaccggcaacaccggcagcgtgctgtccggccgcatctcctacaccttcggcacggtcggccccgccgtcaccgtcgacaccgcctgctcctcctccctcgtcgccgtccacctcgccacccaggcgctgcgggccggcgagtgcaccctcgccctcgccggcggcgtcaccatcatgtccggccccggcaccttcatcgaaatgggccgccagggcgggctctccgccgacggccgctgccgctccttcggcgacaccgccgacggcaccggctgggccgaaggcgtcggcatcctcgtcctggaacggctgtccgacgccgtccgcaacggccacgagatcctcgccgtcgtccgcggcaccgccgtcaaccaggacggcgcctccaacggcctgaccgcccccaacggcccctcccagcagcaggtcatccagcaggccctggtcaacgcccgactcgccgccggggacatcgacgtcgtcgaggcgcacggcaccggcaccaccctcggcgaccccgtcgaggcccaggccctgctcgccacctacgggcagaaccgcccggcggaccggccgctgctgctgggctcggtcaagtccaacctcagccacacccaggccgccgccggcgtcgccggcgtgatcaagatggtcatggcgatgcggcacggcaccctgccgcgcaccctgcacgccgaggagcccacccaccacgtcgactggtcgcagggcgccgtgcggctgctgaccgacaccaccgactggcccgccaccggggcgccgcgccgcgccgccgtctcctccttcggcatcagcggcaccaacgcccacaccatcatcgagcaggcccccgaaccgcagcccgaggacgccgcgaccgcgcaggacgacgccgccggcagcacgccggccaccgcccccgtagtgcccggcgtcgtaccggtcctgctctccggccgcaccccggacgccctgcgcggccaggccgcggccctgcgcgccgccctcgacaccggccggcggcccgacctgctcgacctcgcacactccctcgccaccacccgcgccgggttcgagcaccgcgccgtcctcctcgccaccgaccaccccgccctgaccgacggcctcaccgccctcgccgacgccgacgacccggccgccgcccccgcctggatcaccggcaccacccgggccgagacccggctcgccgtcctgttcaccggccagggcgcccaacgcctcggcgcgggacgggaactcgccgcccgtttcccggcgttcgccaccgccctcgacgcggcgctcgacgccttcaccccgcacctcgaccgccccctgcgcgaggtcctgtggggcaccgacgccgccctgctcgaccgcaccgcatacgcccagccggccctcttcgccgtcgaagtggcgctctaccggctgatcgaatcgttcggcgtccgccccgaccacctcgccggccactccgtcggcgagatcgtcgccgcgcacctcgccggggtcctctccctggccgacgccgccaccctcgtcgccgcccgcggtcgcctgatgcaggcgctgcccgacggcggggcgatgatcgccgtccaggcgtcggaagccgacgtcgccccgctgctcgccgggcacgaggaccaggtcgcgatcgccgccgtcaacggcccctccgccgtcgtcctgtccggcgccgaagccaccgtcaccgcgctcgccgaacagctcgccgccgacggccgcaagacccgccggctgcgcgtctcgcacgccttccactcgccgctcatggagccgatgctcgacgccttccgcgccgtcgtcgaagacctcacgctccagccgccgctcctgccggtcgtctccaacctgaccggcaagcccgccaccgtcgcccaactcacctccgccgactactgggtcgaccacgtccggcacgccgtccgcttcgccgacggcatcgactggctcgcccggcacgacaccaccgccttcctcgaactcggccccgacggcgtgctgtccgccatggcccaggactgcctggacgccgccgacgcagacgccgtcaccctccccgccctgcgcgccgggcgccccgaggagcacaccctcaccaccgccctcgccggtctgcacgtccacggcgccaccctggactggaccggctgcttcgccggcaccggcgcccgccgcaccgacctgccgacctacgccttccagcgccgccgctactggcccaaggccctccagagcggcaccgccgacctgcgctcggtcggcctcggtgccgcccaccacccgctgctctccgccgccgtctccctcgccgacgcaggcggcaccctgctcaccggccgcctctcccggcagacccacccctggctcgccgaccacaccgtccgcggcaccaccctgctgcccggtaccgccttcctcgaactcgccgtccgcgccggcgacgaggtcggctgcgaccgcgtcgaggaactcaccctcgccgcaccgctcctgctgcccgaacagggcggcgtccaggtccagttgtggatcggcaaccccgacgtgtccggtcgccgcaccgtcaacgtccacgcccgccccgacaccggcgacgacaccccctggaccgcccacgccaccggcgtcctcaccaccgccgacgcctcccgccagctcccggcttcgtccgagcagggcggcacccccctcgccggcgacccccaccccgccctcgacgcggcccagtggcccccggccggcgccgaaccgctgccgctggacggccactacgaccgcctcgccgacggcggcttcggctacggcccggtcttccagggcctgcgcgccgcctggcgcggcggcgacgtcgtctacgccgaggtcgagctgcccgaggccggccggtccgacgccgaggcgttcggcctccaccccgccctgctcgacgccgccctgcacgccgcgcccttcaccggcctcggcgaacgcggccggggcggcctgccgttctcctgggagggcgtctccctccacgccggcggcgccaccaccctccgcgtccgcctgaccccggtcgccgacgacgcgctcgccctgaccgtcgccgacggcaccggcgcgcccgtgctgtccgtcgactcgctcgtcctgcgcagcgtggcgacccaacagctcgacacggccgccgccgtcgcccgtgacgccctcttccgcctcgactggacccccgtccagccgaccgccaccgaccccgggcccgtcgccctcctcggcgccgaccccttcggcctgctcacccacgccggattcgccgacgccccggcatacccggacctcgccgccctcgccgcggcggacggcccggtcccgaccaccgtcgtgctgtccctcgccggcaccggggacgacgcggccgacccggcccggtccgcacaccgctgcgccgcggaggccctcgccgccgtacagacctggctcgaccaccatgagcgcttcgccgccgcccgcctggtcttcgtgacccgtggtgcgacggtcgggcgtgatgttgctgctgctgcggtgtggggtctggtgcgttcggcgcagtcggagaatccggggtgttttgctctggtcgatctggatccggatggtgcggtgggtgcggctgcgctcgtcgctgcgttggtcagtggtgagccgcagcttgcggtgcgcggtgatgtgttgcgggtcgcgcgtctggtgcggcggccgctcaccgaggtcggtgcgggtgctgatggcaccggggatggcgtcggggatggctctggtgtgtcgttctcgggtgagggtgcggtcctggtcactggtggtacgggtggtctgggtgcggtgttggcgcgtcatctggtggccgagtatggggtgcgggatctgctgttggtcagtcgcagtggtgaacgtgccgtgggtgctggggagttggtggcggagcttgcgggtgtgggtgcgcgggtgcgggtggttgcgtgtgatgtgaccgatcgtgccgcggtggtggagttggttggcgggcatgcggtgtccgcggtggttcatgcggctggtgtgctggatgacggcatggtgggtgcgttgaccggggagcggttgtccgcggtgctgcggccgaaggtggatgctgtctggcatctacatgaggcgacccgcggcctggacctggacgcgttcgtcgtcttctcctccctcgccggggtcttcggcagtcccggccaggccaactacgcggccgcgaacgccttcctggacgcgctgatgacgcggcgccgggcggagggactgcccggcctgtcactcgcatggggaccgtgggagcagtcgggcggaatgacgggcaccctgacggacgtcgacgccgaacggctggcccgctccggtgtcccgccgctctccgtggcgcagggcctggccctcttcgacgctgccgtggccgggaccgacgccacctgcgttccggtccgcctggacctccccgtcctccgcgcacggggtgaagtgccgccgctgctgaggtcgttgatccgcgtccgggcgcgccgagccgccgtcgccggctccgccaccgcgggcaacctcgcccagcgcctgcgccgcctggacgaggacggccgcgacgagatggtcctggacctcgtccgcggtcaggtcgccctcgtcctcggccacgcgaccggtggcgacgtcgacgccggccgtgccttccgcgacctcggcttcgactcgctgaccgccgtcgaactgcgcaaccgcctcaacaccgtcaccggcctgcgcctgcccgccaccctggtcttcgactacccgaccgtccggcacctcgccacgtacgtcctggacgagttgttgggcacggatgccgaggtggcgaccgtgcagccggccgcggttgcggtggcggacgatccgatcgtcatcgtgggcatggcctgccgctaccccggtggcgtcagctcccccgaggacctgtggcgcgtgctcaccgaaggcaccgacgccgtctcgggcttcccgaccaaccgtggttgggacgtcgaatccctctatcacccggaccctgaccacccgggtacctcctacacgcgctcgggtgggttcctgcatgaggcgggggagttcgatccggggttcttcgggatgagtccgcgggaggcgttggcgaccgattcccagcagcggttgttgttggagtcgtcgtgggaggcgatcgagcgggccggtattgatccggtgagtttgcggggtagtcggacgggtgtgttcgcgggggtgatgtacagcgattacagcgcgatgttggcgagtccggagttcgagggtttccagggcagtgggagttcgccgagtttggcgtcgggtcgggtggcctacacgttggggttggaaggcccggcggtgacggtggatacggcgtgttcgtcgtcgttggtggcgatgcactgggcgatgcaggcgttgcgtagtggtgagtgtgggttggcgttggccggtggtgtgacggtgatgtcgacgcctgcggtgtttgtggactttgctcggcagcggggtttgtcgccggatggccggtgcaaggcgtttgcggatgcggccgatggtgtgggctggtccgagggcgtcggcgtgttggtcctggagcggcagtcggacgcggtgcgcaatggtcacgagattttggctgtggtgcggggttcggcggtcaaccaggatggtgcgtccaatggtttgacggcgcccaatggtccgtcgcagcagcgggtgatccggcaggcgttggccagtggtggtctgacggccggtgacgtggatgtggtggaggcgcatggtacgggtacgacgctcggtgatccgatcgaggcgcaggcgttgttggcgacgtatgggcgggatcgtgagcctgagcggccgttgttgttgggttcggtgaagtcgaatctggggcatacgcaggctgctgcgggtgtggcgggcgttatcaagatggtgttggcgatgcggcatggtgtggtgccgcggacgttgcatgtggatgcgccttcttcgcatgtggactggtccgagggtgcggtggagctgctcagtgagcaggcggcctggccggagacgggtcgggtgcggcgggcgggtgtctcctccttcggcatcagcggtaccaatgtgcatgtcatcgtcgagcaggcgccgggcgccaaggcgatcgccgcggccggtgcggcgcggcgcacgccgggtgccgtgccggtgctgctctcggggcgtggccggagtgccctgcggggccaggccgcccgcctgctcggacacctccaggcccgacccgacgccgaactcgtcgatgtcgcactgtcgttggcgaccacccggtcccgcttcgagcagcgggccgccgtcgtggcgcaggaccgcgaccagctgatcgcctcgctgggggcgctggccgccgaccgccccgaccccgccgtcgtcgagggcgaggccgccggacgcggccggaccgcggtgctgttcaccggacagggcagccagcgggccgccatggggcgtgaactccacgaggtgcagccggagttcgccgcggcgttcgacgcggtgtgtgccgttttcgacccgctgttggaccggccgctgcgcgaggtggtgttcgccgaggacggcagcgacgaggccgcactgctggacgagaccggttggacgcagccggctctgttcgccgtcgaggtggcgctgttccggctggtggagagttggggtgtccgtccggacttcgtggccggccattccatcggtgagatcgcggcggcgcacgtcgccggggtgctgacgttggaggacgcctgccgtctggtggccgcgcgggcgacgctgatgcaggcgctgccgaccggcggcgcgatgatcgcgatccaggccaccgaggacgagatcgcggcgcacctcgacgacacggtggcgatcgccgccgtcaacgggccgcagtccgtggtgatctccggtgacgaggaggccgccgaaacgatcgccgccacgttcgccgaacgcgggcgcaagaccaagcggctgcgggtgagccatgccttccactcgccgcggatggacgggatgctggacgccttccggatcgtcgccgaggggctgacctaccgggcgccgcgcatcccgctcgtctccgacctcaccggccggcgcgccgacgatgcggaggtgtgcaccgcggagtactgggtgcggcacgtccgagaggccgtgcggttcgccgactgcgtgcggacgctgcgcgacgccggggccaccaccttcctggaactgggctccgacggcctgctgaccgcgatggccgaggacaccctcggtgacgaccacgacgccgaactggtgccgatgctgcgcgccgggcgcgccgaggaactggccgcggccaccgccctggcccgcctccaggtgcgcggcgtggacgtggactgggcggcgtacctcgccggcaccggcgcccgacgcaccgacctgccgacctacgccttccagcacgcgtactactggccgcagctgccgaccccggccgccgccctcgccgccgccgatcccgccgaccagcagctgtgggccgctgtggagcgcggcgacgcccgcgaactcgccgacatcctcggcctgggcgaacaggacctcacgccgctggactccctgctgcccgccctcacctcgtggcggcgcggcaaccaggagaagcacctcctggacaccctgcgctaccgcgtggagtggacacgactgagcaagccgaccgccccggtcctcgacggcacctggctgctggtcgcctccgacgccaccgcggccgaccagccagccctcctcgacggcctggccgacgccctcggctcgcacggcgcgcgggtgcgtcgcctgcttctggacgactcctgcgcggaccgcgcggtgctcgccgaacgactggcgcggaccgccgacgtggacgccgcgacccaggtgctgtccgtgctgccgctcgacgagcgggacgccgacgactgcccgccgctcacccgcggactggcgctgaccgtcgcgctcgtccaggccctcgccgacaccggcgcccagggccggctgtggaccgccacccgcggcgccgtctccaccaaccccgccgacccggtcacccaccccgtccaggccgctgcctggggcctgggccggggcgtcgccctggagcacccacggctgtggggcggcctggtcgacctgccgcaggtcttcgacgagcgggccggacagcggctcgccgggatcctcgccgtcaaggacgcaccggacggcgaggaccaggtggcgctgcgggccaccggagtctccggccgccggctcgtccgccacaccgtcgaagcgctgcccacggccgcggagttcaccgccaccggcactgtcctgatcactggtggcaccggtggcctgggcgccgaggtcgcccggtggctggcccgcgccggcgcccagcacctcgtcctgaccagccgccgcggcccggacgcgccgggcgccgccgaactccgggccgaactggagggctacgggccgtcggtgtccgtcgtcgcctgcgacgtcgccgaccgggacgcgctcgccgccgtcctcaccgcactgcccgaggaactgccgctgaccggtgtcgtgcacaccgcaggcgtcggccactacggcccgctggacaccctgagcaccgccgagttcgccggcctcaccgccgccaagctcgccggcgccgcccacctcgacgccctgctcgccgaccgcgaactggacttcttcgtcctcttcggctccatcgccggtgtctggggcagtggcaaccagagcgcctacggcgccgccaacgcctacctcgacgcgctcgccctgcaccgccgcgcccgcggcctcgccgcgacctccgtcgcctggggcccgtgggccgaggccggcatggccgccgacgatgccgtttccgagaccctgcgccgccagggcctcggcctgctcgacccggccccggccatgaccgagctgcgccgcgccgtcgtccggcaggacgtcaccgtcaccgtcgccgacgtggactggcagcgctacgcaccgctgttcacctccgcccggcccagcgccctgatcgccggcctgcccgaggtccgcgccctcgccgccgacgagcgcaccgagcaggacgccaccggcgcctccgaggtcgtcacccgcgtccgcgccctggccgaacccgagcaactgcgcctgctgaccgacctcgtccgcaccgagtccgccaccgtcctcggccacagctccgccgacgccgtgcccgagggccgcgccttccgcgacgtcggcttcgactcgctgaccgcggtcgagctccgcaagcgcctgggcgccgcgaccgggctgtccctgcccagcaccatggtcttcgactacccgacaccgctggaactcgcccagtacctgcgggcggagatcctcggcgcggtgctggaagtcgccggcccggtcgccaccggcggcgccgacgacgagccgatcgccatcatcggcatggcctgccgcttccccggcggcgtcagctccccggaacagctgtgggacctggtcgcctccggcaccgacgcgatcagcgagttccccgtcaaccgcggctggcagaccgggcacctcttcgacccggaccccgaccggcccggcaccacctactccacccagggcggcttcctccacgaggccgacgagttcgaccccaccttcttcggcatctcgccccgcgaggcgctggtcatggacccgcagcagcggctcctgctggagaccacctgggagtccttcgagcgcgccgggatccgcccggaaaccctccgatccaccctgaccggcaccttcgtcggctccagctaccaggagtacggcctgggcgcgggcgacggcaccgagggccacatggtcaccggcagcagccccagtgtgctctccggccgactgtcgtacgtcttcggtctggaaggcccggcggtcaccgtcgacaccgcctgctcgtcctcgctcgtggcgctgcacctggcctgccagtcgctgcgcaacggcgagagcaacctggccgtcgccggcggcgccacgatcatgacgacgcccaacccgttcatcgcgttcagccggcagcgcgccctcgccaaggacggccgctgcaaggcgttctccgacgacgcggacggcatgacgctcgccgagggcgtcggcgtcgtcctcgtcgagcggctctccgacgcgcagcgcaacggccacccggtcctggccgtcctccgcggctccgccatcaaccaggacggcgcctccaacggcctgaccgcgcccaacggcccgtcccagcagagggtcatccgccaggccctcgccaacgcccgcctcgcgcccggggacatcgacgccctggaggcgcacggcaccggcacaccgctcggcgaccccatcgaggcccaggcactgttcgccacctacggccgcgaccgcgaccccgagagcgcgctgctgctcggctcggtgaagtccaacatcggccacacccagtccgccgcgggcatcgccagcgtcatcaagatggtcatggcgctgcgccactccgaactgccgccgaccctgcacgccgacgcgccgtcctcgcacgtggactggtcggccgggacggtccggctgctgacccaggcgcgcgcctggccggagaccggtcgcccgcgccgggccgcggtgtcctcgttcggcatcagcggtaccaacgcccatgtcctgctggagcaggcgcccgtcgcggacaccccggccgaggagcggcccgccgtggcgccggtcccgatcgccgccggcgtcgtcccgtgggtggtcaccgcccgcagcgccgccgccctgcgcggccaggccgagcgcctcctcgcgcacgccgaaaccgtcggaaccgccctgccggccgccggaccgctcgacatcggcctgtcgctggtctccgcgcgcgcccgtttcgagcaccgtgccgtcgtcgtcccgcccgcgggcaccgacccgctggccgcgctgcgcgccgtcgcgacggacgggccctcgcccgtggtcgcccgtggcgtggcggacgtcgagggtcggacggtgttcgtgttccccggtcagggttcgcagtgggtggggatggggtcccaactccttgatgagtcggcggtgttcgcggagcggattgccgagtgtgcggcggcactcgccgagttcaccgactggtcgctggtcgatgtgctgcggggtgtggtgggtgcgccgtcgttggagcgggtcgatgtggtgcagccggcgtcgttcgcggtgatggtgtcgttggctgcgttgtggcgttcccgtggtgtgttgccggatgcggtggtggggcattcgcagggtgagatcgctgctgcggtggtgtcgggtgcgctgtcgttgcgggacggggcgcgggtggtggcgctgcggagtcaggccattggtcgtgcgttggcggggcggggagggatgatgtccgtcgcgctgtcggtggacgtgctcgaaccgcggttggtcgagttcgaggggcgggtgtcggtggccgccgtcaacggcccgcgctccgtcgtggtcgccggcgagcccgaggcgctggacgcgctgcacgcccggctgaccgccgacgacatccgggcccgccggatcgcggtggactacgcctcgcactcgcaccaggtcgaggacctgcacgaggaactgctggaggtgctggcggagctggcgccgcgcacgtcggaggtgccgttcttctcgaccgtgaccggcgactggctggacaccgcgcggatggacgccggctactggttccgcaacctgcgcggacgggtgcggttcgcggacgcggtggcggacctgctggcggcggagtaccgcgcattcgtcgaggtcagctcgcacccggtgctgtcgatggcggtgcaggaggcgatcgacgaggccggcgtgccggccgtcgccgccggcaccctgcgccgcgaccagggcggcaccgaccgcttcctgctgtcggccgccgaggtcttcgtgcgcggtgtggacgtggactgggcggggctgttcgaggggaccggtgcgtcccggatcgacctgcccacctacgccttccaacacgaacacctgtgggccgtcccgcccgccccggaggccgtcgccgccgccgacccggacgacgcggccttctggaccgcggtcgaggacggtgacgtctccgcgctgaccgccgcgctcggcaccgacgaggactccgtcgccgccgtgctgcccgccctgacctcctggcgccgggcccgccgcgaccgctccaccgtggacgcctggcgctaccgcgtcgcctggaaacccctcggcggcaccctgccgcacccgtccctgaccggcacctggctgctggtcaccgccgacggcatcgacgacaccgatgtggcaggggcgttggagacctacggcgccgaggtgcgccggctggtcctggacgaggagtgcgtcgaccgcgccgtcctgcgggagcggctggccggcgcggaggacgtgaccggcatcgtctccgtcctcgccgccgccgagcggaccgacgcggtaccgggcacctccctggtgctcggcaccgccctgaccgtggcactgatccaggccctcggcgacgccgaaatcgacgctcccgtatgggcgttgacccgcggcgcggtctccaccggccgggccgacgagctgaccgcgcccgtccaggcacaggtcaccggcatcggctggaccgcggcgctggagcacccgcagcgctggggcggcaccctcgacctgcccgccgccctcgacgcccgggccgcccagcggctcgccgccgtgctgtccggcgccctcggcagcgacgaccagctggccatccggccctccggggtcttcacccgccgcatcgtgcgggccgaggccaccgccgggcggcccgccggcacctggacgccgcgcggcaccacactggtcaccggcggctccggcaccctcgccccgcacctcgcccgctggctggcccaacgcggcgccgagcacctggtcctgatcagccggcgcggcacggccgccccgggcgccgccgaactcgtcgcggaactggccgagtcgggcaccgaggcgaccgtcgccgcctgcgacatcaccgaccgcgacgcggtcgccgcgctgctggccgacctcaaggccgacgggcgcaccgtccgcaccgtcgtgcacaccgccgccaccatcgagctgcacaccctggacgccaccaccctggcggacttcgaccgggtgctgcacgccaaggtcaccggcgcccaggtcctcgccgaactgctcgacgacgaagagctggacgacttcgtcctgtactcctccaccgccggcatgtggggcagcggcgcccacgccgcctacgtcgccggcaacgcctacctcgccgcgctcgccgagcaccgccgggccaacggactgcccgccctgtcgctgtcctggggcatctgggccgacgacctcaaactgggccgggtcgatccccagatgatccggcgcagcggcctggagttcatggacccgcagctggccctgagcggcctgcagcgggcgctggacgacaacgagaacgtgctcgcggtcgccgacgtggactgggagacctaccaccccgtctacacctccggccgacccaccccgctcttcgacgaggtgccggaggtccgccggctcaccgcggccgccgagcagagcgccgggaccgtcgccgagggcgagttcgccgccgcgctgcgcgccctgtccgacgccgagcagcagcgcaccctgctggagaccgtccgcaccgaggcggcgtccgtcctcgggctgtcctccgccgaggacctcaccgaccagcgggccttccgcgacgtcggcttcgactcgctgaccgccgtcggcctgcgcaaccggctcgcctccgtcaccggcctgacgctgccctcgacgatggtcttcgactaccccaacccggccgcgctcgccgcctatctgcacggcgagctggccggcgcccggtccgccgccgccggcgccgccgccgtcccgaccggcgcccccgacgccgacgacccgatcgcgatcgtcggcatgagctgccgctaccccggcggggtcggctccgccgaggacctgtggcggatcgccctggacgaggtcgacgcgatctccggcttccccgccgaccgcggctgggacgccgagggcctctacgacccggaccccgaccggcccggccgcacctactccgtccagggcggattcctgcgcgacgtcgccgagttcgacccgggcttcttcgggatctcgccgcgcgaggcgctgtcgatggacccgcagcagcggctcctgctggagaccgcctgggaggcgttcgagcacgccggcatcgacccggtcggccagcgcggcagccgcaccggcaccttcgtcggcgccagctaccaggactacgcctccggcgtgcccaacagcgagggctccgaaggccacatgatcaccggcacgctctccagtgtgctgtccggccgggtgtcctacctcttcggcttcgagggccccgccgtcacgctcgacaccgcctgctcctcctccctggtcgccatgcacctggcctgccagtccctgcgcaacggggagagctcgctggccctggccggcggcgtcagcatcatgtccaccccgatgtcgttcgtcggcttcagccggcagcgcgccctcgccgaggacggccgctgcaaggcgtacgcggacggcgccgacgggatgaccctcgccgagggcgtcggcctggtgctgctggagcggctgtccgacgcccgcgccaacgggcaccaggtgctcgccgtgatccgcggctccgccgtcaaccaggacggcgcctccaacggcctgaccgcacccaacggcccgtcccagcagcgcgtcatccgccaggcgctggccaactccgcggtggcgcccggcgacatcgacgtcctggagggccacggcaccggtaccgccctcggcgaccccatcgaggcgcaggccctgctcgccacctacggccaggaccgcgcccccgaacggccgctgctgctcggctcggtgaagtccaacatcggccacacccagatggcatccggcgtcgccagcgtcatcaagctcgtccgcgccctccaggaaggcgtggtgcccaagtccctgcacatcgaccggccctccacccacgtcgactggtcctcgggcgccatcgggctgctcaccgaacgcaccccgtggcccgagaccggccggccgcgccgcgccgccgtctcctccttcggcatcagcggcaccaacgtccacaccatcctcgaacaggcccccgcggacgaggcgcccacgcccgccgacccgccgcgggacggcctggtgccggtcctgctctccggccgcggcgaggccgcgctgcgcgcccaggccgcccgcctgctcgccttcgtcgaggagcggcccgaggcccacctcaccgacctcgcccactccctcgccacctcgcgcgccgcgctggaacgccgcgccgccgtcatcgccgccgaccgcgacaccctgacccgcggcctgcgcgccctgtccgacggccggcccgaccccggcctggtccagggcaccgcgggacgcggccggaccgccttcctgttcaccggacagggcagccagcgccccggcatgggccgcgaactccacgaccgctacccggtgttcgccgacgcgctggacgaggtgctggcccggctcgacgacggaccggaccggccgctgcgcgaggtgctgttcgccgcgcccgactccgccgaggccgcgctcctggaccggaccggctacgcccagcccgcgctgttcgccgtcgaggtcgcgctgttccgcctgctgacgtcctggggcctgaccccggactacctggccggccactccgtcggcgaactcgccgccgcgcacgtcgccggcgtgctgtcgctggacgacgcctgcactctggtcgccgcccgcggccggctcatgcaggcgctgcccgagggcggcgcgatggtcgccctggaggccgcggaggacgaggtcctgccgctcctggaggggctcaccgaccgggtgtccgtcgccgccgtcaacgggccgcggtccgtggtcgtcgccggcgtcgaggaggacgtgctcctcctcgccgacctcttcgccgccgacgggcgccggaccaagcggctgcgggtgagccatgccttccactcgccgctgatggacgccatgctcgacgacttcgccgccgtcgcccgcgggctgacctaccacccgccgacgatcccgttcgtgtcgaacgtcagcggcggcctggccaccgccgaacaggtccgcacgcccgactactgggtcgggcacgtccgcgccgcggtccgcttcgccgacggcatcgactggctcgccacccagggcgacgtccacaccttcctggagctcggcccggacggcgtgctcagcgccatggcccgggagagcctcaccgacccgtcccgcacggcactgctgccgaccctgcgcggcgaccggcccgaggaacctgccctggtcaccgcggtcgccgcggcccacgcgcacggcgcccgcgtcgactggagcgggtacttcgccgaccacggcgcgcgccggaccacgctgccgacctacgcgttccaacgcgagcggtactggcccgacaccaccgccgccacgagcgcccacacgcccggatccgccctcgacgccgagttctgggccgccgtcgagcgggacgacgtcgccgccctcgccgcctccctggacctggacgacgccaccgtcaccgcgatggtccccgcgctcaccgcctggcgccggcgccgcggcgagcagaccgaactggactcctggcgctaccgcgtcacctggaagccgcgcggcggcgccaccgcacccgccgccctcaccggccgctggctcgtgctcgtcccgcacgaccaccaggaccgtcaggacgacgcgaccgcggcctgggcagccgacgtcgagaccgccctgggcaccaccaccgtccggctgacggtcaccaccaccgaccgcgccgcgctggccgcccggatcaccgaagccgccggcgaccagggcccgttcagcggtgtgctgtccctgctgccgctcgccaccggcgacgccggccaccccggtgcgcccgccgccctcaccctcaccaccaccgccgtccaggccctcggcgacgccggcatcgacgcgccgctgtggaacgtcacccgcggggccgtggccgtcggccgcgccgaacaggtcaccgcgcccgaacaggccgccgtctggggcctgggccgcgccgtcgccctggaactgccggcccggttcggcggcaccctcgacctgcccgccaccctggacggccaggccgcccgccggttgcgcgcggtgctcgcggctaccgacggcgaggacgcggtggccctgcggccctccggcgtcttcctccgccgcctggcccacgccccggccggccccgacaccgcccgcaccgccttcgacccggcggccggcaccgtcctgatcaccggcggcaccggcggcatcggcggccacgtcgcccgccgcctggcccgcgacggcgccacccacctgctgctcaccagccgccgcggcccggccgcccccggcgccgacgcgctccgcgccgaactggaggaactgggcgcccgggtcaccctcgccgcctgcgacgccgccgaccgcgacgcgctggccgcgctcctcgccgaactgcccgacgacgccccgctgtgcgcggtgttccacaccgccggcgtcgtcgaggaccacgtcgtggacgcgctcacaccggagaacttcgccgcggtgctgcgcgccaagaccgtcgccgcccaccacctgcacgagctgaccgccgacctggacctcgccgctttcgtgctgttctcctccacggccggcgtcctcggcgccgccggacagggcaactacgccgcggccaacgcccacctggacgccctcgccgaacaccgccgctcccacggcctgaccgcgctgtccgtcgcctggggcccgtgggccggctccggcatggtcgccgacgccgccgaactcaccgaccgggtacggcgcggcggcttcgaaccgctcgcccccgaaccggccgtgcgcgccctgctgcgcgccatcgagaacgacgacaccaccgtcgcgctcgccgacatcgactgggagcgcttccagcgcgccttcgccgcggtccgcccgctgccgttcgtcgccgacctccccgagaccggccgggccacccccgcgaccgccaccggcgccgccaccggcctgcggcagcaactcgccgaactgccggagcacgagcgcccggcagcggtcctggacctgctgcgtacccaggtcgccgccgtcctcggccacgccgacccgcgcaccgtcgaggacgaccacgccttccgcgacctgggcttcgactcgctgaccatcctggaactgcgcaacgccctcaacgccgccaccggcctgagcctgcccgccaccctggtctacgacctgcccaccccgcgcgagatggcggacttcctgctcgccgaactcctcggcaccctgcccaccgacaccgccgcgaccgtcgccagcacggcctcccccaagctctcagcttcgttcgagcagggcggtacccccttcgacgacccgatcgccgtcatcggcatcggctgccgcttccccggcggcgtcaccaccccggaggagctctggcagctcctcgacgagggccgcgacggcatcagccgcttccccgacgaccgcggctgggacctcgccgcgctgggcgccggcgcctccgacaccctggagggcggcttcctgaccggcgtcgccgacttcgacgcccggttcttcggcatctcgccccgcgaggcgctggccatggacccccagcagcggctgctgctggagaccacctgggaggcgctggagcgggccggcatcgacccgaccacgctgcgcggctccaccaccggcgtcttcgtcggcaccaacggccaggactacccgacgctgttgcgccgctccgcctcggacgtggccggctacgtcgccaccggcaacaccgccagcgtgatgtccggccgcctgtcctacgcgctcggcctcgaaggcccggccgtcaccatcgacaccgcctgctcctcctcgctcgtcgccctgcactgggccggccgggcgctgcgcgccggcgagtgcgacctcgtggtggccggcggcgtctcggtcatggccagcccggactccttcgtcgagttctccacccagggcggcctggcacccgacgggcgctgcaaggcgttctccgacgccgccgacggcaccgcctggtccgaaggcgtcggcatcctcgtcctggaacgcctctccgccgcccgccgcaacggccaccaggtcctcggcctgatccgcggcaccgccgtcaaccaggacggcgcgtccaacggcctgaccgcgcccaacggcctctcccagcagcgcgtcatcgcccaggcactcgccgacgcccgcctgcgccccgccgacatcgacgcgatcgaggcgcacggcaccggcaccaccctcggcgacccgatcgaggcccgcgccctgatcaccgcctacggccgggaccgggacgccgaacggccgctgctgctgggcaccgtcaagtccaacatcgggcacacccaggccgccgccggtgccgccggcgtcatcaagatgctgatggcgatgcgccacggcaccctgcccaggacgctgcacgtgggcaccccgtccagccacgtcgactggagcggcggcaccgtcgcgctcctcgacgacgcgcggccctggccacggaccgggcagccgcggcgcgccggcgtctccgccttcggcgtcagcggcaccaacgcccacgtcgtcgtcgagcaggccccggaaaccgaagcccccgccgccccggccgccgagccggcgccggaggccacgcccaccgtcgtcccctgggtcgtctccggacgcagccgggaagcgctccaggcgcagctggaccggctcaccgcgcacaccgccgcccaccccgcgcgctcggcggcggacgtcggccgctcgctggccaccgaccgcacgctcttcccgcaccgcgccgtgctgctcgccggcccggacggggtgcgcgaggccgcccgcgccgccgcgccccgcacccccggccgcaccgcgttcctgttctccggacagggcgcccagcacgccctgatgggccacgacctgtaccagcgcttcccggtctacgccgacgcactggacaccgtcctcgcccagttcgacaccgtgctggacgtcccgctgcgcgccgcgctgttcgccgcgccgggcacccccgaggccgcgctcctggaccagaccggcttcacccagcccgcgctgttcgccgtcgaggtcgcactgttccggctcgccgagtcctggcggctgacgccggacttcgtcgccggccactccatcggcgagatcgccgccgcgcacgtcgccggggtgttctccctggaggacgcctgcacgctggtcgccgcccgcgcctccctcatgcagcaactgccgcgggacggtgcgatggtggccctggaagccaccgaggacgaggtcgcgccgctgctcaccgacggcgtcgcactcgccgcggtcaacggcccccgctcggtggtcgtcgcgggcgccgaggacgccgtccgcgcggtcgccgaccggctcgccgccgacggccgccgcacccgccggctgacggtcagccacgccttccactcgccgctgatggacccgatgctcaccgacttcgcccgggtcgcggagggcctgacctaccacgagccgcgcatccccctcgtctccaccctcctcggcgccccggccggcgccgaactgcgcacccccgactactgggtgcggcacgtccgcgagaccgtgcggttcgccgacggcgtgcgcgccctgcacgacgccggcgccggcaccttcgtggagatcggcccggacggcgtgctcaccgccctgacccagcagaccctcgacaccgtcgaggccggcgcgcccgccgtcgtcgtgccgctccagcgccgcgaccgcgccggcgacctcgccctcctggagggcctggccaccctgcacacccacggcaccggcccgtcctggcccgcctacttcgaggccaccggcggccaccggaccgatctgcccacctacgccttccagcgggagcggtactggcccgaactcggcgcacccgtcgccaccgccccgcaggacccggcggcctggcgctaccacgagacctgggccccgctgccggcacccgaggcggccgcgccggccggccgcgccctggtcctcgtcccggccgggaaccgcgacaccgcgtggatgacggccgtcgccgacgcgctcggcgccgacaccgtcacggccgaacccgacgccctggccgagcagttgacggccgccggcgacacaccctggcgcgtcgtggtgtcgctgctcgccgccgcgtccgaggggctgcccgcggacggcgcctggcccgccgccctcctcgccaccctggacgaggccggcgtgcacgcgcccctgtggtgcgtcacccgcggcgccgtcgcggtcgcgggggaggccccgaccgccgtcggccaggccgccctgtggggcctgggccgggtcgccgcgctggaccacccggaccgcttcggcggcctggccgacctgcccgccgacaccgacgcgcacgccgccgggctgctcgccgcgcacctggccgcgccgggcaccgaggccgagatcgcggtccgcgccaccggcgtccacgcccgtcgcctggtccgtacgccggccgccgccgacggtgccacctggctgccgaccggcaccgtcctggttgtcggcggcaccggcggcaccggcaccatgggcggccgggccgcccgctggctggtccgcgagggcgcccgccacctcgtcctgaccgcccccgacggcaccacgaccgccgcggacaccgaggccctgacggccgaactggccgcgctcggcgcccggatcaccgtcgtggaccacgaccccaccgccccggacggcttcgccgcgctcctcgacggactgcccgacgacaccccgctcaccgcggtcgtgtacgcgccggaggccgacgccgcccccggcaccgcggccgagctgtccgccgcactcgcccccgtcaccgccctaggcgccgccctcaccggccggccgctggacgccttcgtcctcttcggctccatcgccgggctctggggcgtgcgcggccgggccgccgaggccgcgtccggcgcctacctcgacgccttcgcccgcgcctgccgcgaccgcggcaccccggcactggccgtcgcctggggcgcctgggccgacctggtcggcccgtccctcgccgcgcacctgcggatgaacggcctgccggtgatggacgcggacaccgcactgaccgccctcagccgggccgtcgccgacgggtccgccgccgaggcggtcgccgacgtccgctgggagaccttcgcgcccctccaccacgaggcccgccgcaccgccctgttcgacgccctgcccgaggcccgcggcgcgctcgcggaggccgcccgggaccgcgccgaccggaagaccgccgccggcgactacggccggtggctcgccgagcagcccgccgcggaccacgacgccatcctgctggcactggtcaccgagaaggccgcgaccgtcctcggccacgccgaccacgacctgctcgaacccgacctgcccttccgcgacctgggcttcgactcgctgaccgcggtcgacctgcgcaaccagctcaccgcggaaaccggcctcaccctgcccgccaccctcgtcttcgaccaccccaacccggccgccctcgccgcccacctgcgcgcccaactcctcggcgaggcgagcgactccgccgcaccggtggccgcccccgtcgccctcggtgccgacgacgacgcgatcgtcatcgtcggcatggcctgccgctaccccggcggggtcacctcgcccgaggacctgtggcagctggtcggcgacgaggtcgacgcggtcggcgacttcccgaccgaccgcggctgggacctggccgcgctcgccggcgacggaccgggccgcagtgccaccgcccagggcggattcctctacgacgccaccgacttcgaccccggcctgttcggcatctcgccgcgcgaggccctggtgatggacccgcagcagcggatcctgctcgaaacgtcctgggaggccctggagcgggccggcatcgacccggcgacgctgcgcggcagcggcaccaccggcgtcttcgtcggcggcggctccggcgactaccggccgccggaggaggccgggcagtggcagaccgcccagtccgccagcctgctctccggtcgcctcgcctacaccttcggcatccagggccccaccgtgtcggtcgacaccgcctgctcctcgtcgctggtcgcgctgcacctggccgcgcaggccctgcgcgccggcgaatgctcgatcgcgctggccggcggcgtcaccgtgatggccaccccggtgggcttcgtcgagttcagcgcccagggcgccctgtcgccggacggccgctgccgcgccttctccgacgacgccaacggcaccggctggtccgaaggcgtgggcatgctcgtcgtcgaacggctctccgacgcccgccgcaacggccaccgcgtcctcgccgtgctccgcggctccgccatcaaccaggacggcgcgtccaacggcctgaccgcccccagcggccccgcccagcagcgcgtcatccgccaggccctcgccaacgcccgactgcgccccgccgacatcgacgccgtcgaggcccacggcaccggcaccaggctcggcgaccccatcgaggcccaggccctgctcgccacctacggccaggaccgcgagcggcccgtgctgctcggctcgctcaagtccaacatcggccacacccaggccgcctccggcgtcggcggcgtcatcaagatggtcctcgccatgcagcacggcgaactgccgcgctccctgtacgccgagaacccctcgtcgcacgtggactggaccgccggccgcgcccacctgctcaccgccaggaccccgtggcccgactccggtcggccgcgccgcgccgccgtctcctccttcggcgccagcggcaccaacgcccacgccatcctggagcagccgccgcgcgaggaactccccgcgcgccccgcggacgacggcgccccgctgccgttcttgctctccggccgctcgcagaacgccctgcgcgcccaggcccgccgactcctggcccgcctcaccgcccaccccgacacccgggccgccgacctggcgtactccctggcgaccacccgggccgccttcgagcaccgggccgcgatcaccgccaccgaccacgacggcctccgcaccggcctgaccgccgtcgccgagggcaccaccgccccgcacaccgccgaacaccacctccagggcaccggaaagcgcgccgtgctcttctccggccagggctcccagcgcctgggcatgggccgcgaactgcacgagcgccacccggtgttcgccgaggcgttcgactccgtactggcccgcctcgacgaccggctcgacacccccctgcgggacgtcgtctggggcaccgacgaggaggcgctgcacgccaccgggaacacccagcccgccctgttcgccgtcgaagtcgcgctctaccgcctgatcgaatcctggggcgtgcggcccgacttcgtggccggccactccgtcggcgagctcgccgcggcccacgtcgccggggtgctctccctggacgacgcctgccgcctggtcgccgcccgcgccgccctcatgcagcgcctcccggccggcggcgccatgatcgccgtcgaggccaccgaggacgaggtcaccccgctcctcaccgacggcgtgtccctcgccgcggtcaacggaccgaccgccgtggtcctctccggcgcgggcgacgccgtgaccgccctgggccaggcgctggccgaacggggccaccgcaccacccggctgcgggtcagccacgccttccactcgcacctcatggacccgatgctggcggacttccgcaccgtcgccgagggcctggaataccacccgccgcgcatccccgtggtctccaacctcaccggggacgtcgccgacgcggccgacctgtgctccgccgactactgggtgcgccacgtccgcggcaccgtacggttcgccgacggcgtgcgcaccatggccgaccgcggcgtgcacctcttcctcgaactcggcccggacgccgtgctgtcggccatggcccgccagtgcgcaccggacgccgtcgtcgtcccggccctgcgccgcaaccgcgacgaggacgagacgctggtcggcgccgtcgcgcgactgcacgtccacggcgcgggtccgcgctgggacgcgtacttcgccggccgcggcgcccagtggctggaccttccgacgtaccccttccagcgcggccgcttctggccggagtcccttccgggcgccgcatcggccgccccggcagccggacagccggccgagaccgacgcggccttctgggacgccgtcgcacaggaggacttcaccgcattggaatccgtactcgacgtcgagagcgacgcactgtccaaggtgctgccggccctgatggactggcgcagccgccaggccgacgagtcccaactggcaggctggcgccaccgcatcgtctggaagcggctcaccggcgccgccctggcacaccgcaaggcgctcagcggcacctggctcgcggtggtccccgagggcttcgccgacgacccctgggtgaccaccaccctggacggcctcggtacccacctcgtgcatctggaggtcgcggaggccgaccgggccgcgctggccgacgcgatcgcggcccgcaccgccgacggcacccgcttcggcggcgtaatctccctgctggccctgcgcgaggagctcaccggcgcggtgcccgaggggaccgccctgaccaccaccctcctccaggccctcggcgacgccggcgtcgacgcaccgctgtggtgcgtcacccgcagcgccgtctccgccggccgcaccgaccggccgcaccgaccgctccaaggcgccgtctggggcctgggccgggtcgcggcccttgagtacccgcagcgctggggcggcctggtggacctgccggaggagcccgacgagcggtccgcggccggcctcgccgccgtcctggccggtctggacggcgaggaccaggtcgccgtgcgcggcaccgcggtgctcgcccgccgcctggtgccggctcccggccgcaagccgtcccggccctggcacccgtccggcaccgtcctggtcaccggcggcaccggcgccctcggcgcgcacgtcgcccgccgcctggccaaggacggcgcccagcacctcgtcctgctcagccgccgcggcccggacgctcccggtgcggcggaactgcgcgcggaactggacgcgttgggcaccgacgtcacggtcgccgcctgcgacgtcgccgaccgcgaccagctgacggccgtcctggacgcgctgcccgccgaccggccgctgaccggtgtggtgcacaccgccggcgtcctcgacgacggcgtactggaccggctcacccccgagcggttccaggaggtgttccgcgccaaggtcacctcggccctgctgctggacgagctgacccgcgaccgcgagctggccgcgttcgtcctcttctcctccgcctccgccgcggtcggcaacccgggccaggccaactacgccgctgccaacgccgtcctggacgcgctcgccgaacagcgccgggtgctcggcctgcccgccacctcggtctcctggggtgcctggggaggcggcggcatggccgacgccgacggcgcggacgaggccgcccggcgcgccggcgtcggcgccatggacccgcacctcgccgtggaagccctgctgcgcctggtcgccgagaaggagccgaccgcggtggtcgccgaggtggccctggaccggttcgccggcgccttcggcggcagccgacccagcgccctgctgcgggagttccccggctaccgcgaggcgctcgccgcccaggcggagcaggccgcggacggcggcgggctggccgcccgactggccgcgctgccgcccgcccgccgcctggacaccgttgtggacctggtgcgcacccgcgccgcgcaggtgctcggctaccccgacaccgaagcggtcgccgccgaacggtccttccgcgacctgggtgtcgactcgctcggcgccgtcgagctgcgcaaccaactgagcgcggccaccggcctgaacctgccggcgacgctggtgttcgaccacccgacccccctggtcctgggggagcacatcctcggcgggctcttcccggacgagcccgccgggtccgacgacgagacggagatccgggccctgctggcctccgtcccgctcgaccaactgcgggagatcggggtcctggagcccctgctccagctcgccggacgcggcggccgggccgcggacggcgacgacggcgagtccgtcgactcgatgacagtggcagacctggtgcgggccgcgctcaacggccagtccgacctgtagcgcgattgatggagcagacgatgaacgcgcccgagaaccccgagacccccgagaacaacgtagtcgccgcactccgcgccgcggtcaaggagaccgaccggctccggcggcagaaccggatgctggtcgcggcggccaaggaaccgatcgccgtggtcggcatggcctgccgcttccccggcgccgtcgactccccggaagcgctgtgggagatggtcgccaccggcaccgacgtgatctccggattccccgacgaccgcggctgggacctggaggcgctgcgcaacagcggcaccgacgcccgcgacaccgacgtcagccagcgcggcggattcctggactgcatcgccgacttcgaccccggcttcttcgggatctcaccgcgcgaggcggtcaccatggacccgcaacagcggctcctgctgaccaccgcctgggaggccgtcgagcgggccggcatcgacgccaccacgctgcgcgccacccgcaccggcgcgttcatcggcaccaacggccaggactacgcctacctgctcgtccgctccctggacgacgccaccggcgacgtcggcaccggcatcgccgccagcgccgcctccggtcggctctcctacaccctcggcctcgaaggccccgcgctcaccgtcgacaccgcctgctcctcgtcgctggtcgccctgcacctggccgtgcaggcgctgcgcaacggcgagtgcggcatggcgctggccggcggcgtcaacgtgatggccacaccgggctcgctggtcgagttcagccgccagggcgggctggcccgggacggccgctgcaaggcgttcgcggacgccgccgacggcaccggctggtccgagggcgccggcgtgctgctgctggaacggctctccgacgcccagcgcaacggccacccggtgctcgccgtggtccgcggctccgccgtcaaccaggacggcgcctccaacggcttcaccgcccccaacggcccctcccagcagcgcgtcatccgccaggccctcgccaacgccggcctggccaccggcgacatcgacgcggtcgaggcgcacgggaccggcaccccgctcggcgaccccatcgaggcgcagagcatcctcgccacctacggccaggaccgcgcccacccggtgctgctcggctcgatcaagtcgaacatgggccacacccaggccgcgtccggcgtcgccggcgtgatcaagatgatcatggcgatgcggcacggcgtcctcccgcggaccctgcacgtcgaccggccctccacccacgtcgactggaccaccggcagcgtcgaactcctcaccgacgcccacccgtggcccgagactggcaggccgcgccgcaccggcatctcctccttcggcgtcagcggcaccaacgcccacgtcatcgtcgaacaggcccccgacacccccgccgaggcggctgacgacactccgccccgcaccccgcggaccctgccgtggctgctctccgcccgcaccggcgccgccctgcgcgaccaggccaccgcgctgctcgaccacctcgaccgccccgacggcgaccgcgggcccaccgccctggacaccgcgttctccctcgccaccacccgcgccgccctggaacaccggctcgccgtcgtcaccggcaccgacggcaccgccggacgggacgccctgaccgcctggctggcgcacggcaccgcccccgacgcccacgaaggacacgccgccggacgcacccgctgcgcggccctcttctccggccagggcgcccagcgcctgggcatgggccgcgaactccacgcccgtttcccggtgttcgcacgggccctcgacaccgccgtggacctgctcgacgccgaactgggcggcaccctgcgggaggtgatctggggcaccgacgacgcgccgctcaacgagaccggcttcacccagcccgccctgttcgccgtcgaggtcgccctctaccgcctgatcgaatcctggggcgtcgccccggacttcgtcgccggccactccatcggcgagatcgccgccgcgcacgtcgccggggtgttctccctggaggacgcctgcacgctggtggccgcccgcgccgggctgatgcaggcgctgccgcgcggcggggcgatggtcgccgtcgaggccaccgaggacgaggtcagcccgctgctcaccgacggcgtcgcgatcgccgcgatcaacggccccacctcgctcgtcgtctccggcgacgagaccgccaccctcgccgtcgccgcccgactcgccgaacagggccgccgcaccacccggctgcgggtcagccacgccttccactcgccgctgatggacccgatgctcgcggagttccgcgcggtcgccgagggcctgtcctacggcgaaccgcagatcccggtggtctccaacctcaccggcgcggtcgccgacggcaccctgctcggcactgccgactactgggtccggcacgtccgcgaggcggtccgcttcgccgacggcatccgcgccctcaccgacgccggcgtcggcgccttcctcgaactcggcccggacggcacgctcgccgccctggcccagcagtccgcccccgacgccgtctccgtccccgtcctgcgcaaggaccgggacgaggagcccgccgcggtcgccgcactggcccggctgcacaccgccggcgtcccggtggactggacggcgttctacgccggcaccggcgcccaccgcaccgacctgccgacctacgccttccagtacgagcgctactggcccaaggccacctaccggcccgccgacgccaccggcctcggcctgaccgccgccgaccacccgctgctcggcgccgccatgtccgtcgccgggtccgacgagctcctgctcaccggcaccctgtcgctcgccacccacccctggctcgccgaccacgtcgtcggcggcatggtcttcttccccggcaccggcttcctggaactggcggtccgcgccgccgaccaggtcggctgcgaccgggtcgaggaactcatgctcgccgcgccgctgatcctgcccgccaccggcaccgtccagatgcagatcgcggtcggcgccgcggacgacgacggcggccgcgacctgcgcttcttcacccggcccggggacgacccggacgccgcctgggcccagcacgccaccggccggatcaccgagggcgagcgcgtcctcgccctcgacaccaccacctggccgccccgcgacgcggaacccgtcgacatcgacggcctctacgaccgctaccgcgccaacggactcgactacgggcccgtcttccgcggcctgcgcgccgtatggcgccgcgacaccgagatctacgccgaggtcgccctgcccgaaggcaccgccgacgccgacgccttcggcctgcacccggccctcttcgacgccgtcctgcacagcaccctcttcgcctccgccgacggcgacgaccgcagcctcctgccgttcgcctggaacggcgtgtccctgcacgccgcgggcgcggacgcgctgcgcgtccggatcaccagctgcggccccgacgccgtggagatcaccgccgtcgacccgcagggccgccccgtcgtctccgtcgaatcgctgacgctgcgcgccgccggccccgacgccggcaccgccgaccaccgtgccgacgcgggctccctcttccgcatggactggacgccccgcaccgtccacgccccggccacccccgccacctgggccgtcctcggtaccgacccgatcggcctgaccgaggcgctcaccgccgccggccccgacaccgtcacgggactccgcgacggtgtcgacgccctcggcgaactcaccgccggcgacgaccggccggtgcccgacgtggtcgcggtaccgctgcgcggcgccaccgaccacgggccggccggtgcccacgacctgacccgcaccgtcctggccctgctccaggaatggctggccgaggagcgcttcgcccgctcccggctgctgctcgtcacccgcggcgcggtcgccgacggcgagcgcggcccgctcgacctggccgccgccccggtctggggcctggtgcgctccgcccagtccgagaaccccggccgactgctgctcgtcgacctcgacgacaccgccgagtccgccgcccaactcccgttgctgccggccctcctggacgccgacgagccgcaggccgtggtccgcgagggcaccgtccgggtcggccggctcgcccgcctggactccggccgcggcctcgtcccgccgcccggcaccccctggcgcctgggcagccgggccaagggcagcctcgacggcctcgccctgctgccccaccccgaggcccgacgacccctcaccggccacgaggtccgcgtcggcatccgcgccgcgggcctgaacttccgtgacgtgctcaacgcgttggggatgtatcccggggatgcggggctgttcggttcggaggcggccggtgtggtcgtcgaggtcggaccggaggtcaccggcctggcacccggcgaccgggtcatgggcatgctcttcggcggcttcggaccgctcggcatcgccgacgcccggctgctcacccccgtcccggccgactggtcctgggagacgggtgcgtcggtgccgttggtgttcctcaccgcgtactacgccctgaaggagttgggtggtctgcgggcgggggagaaggtgctggtgcatgccggtgccggtggtgtcggtatggcggcgatccagatcgcccggcatgtcggtgccgaggtgttcgccacggccagtgagggcaagtgggacgtgctgcgctccctgggcgtggccgacgaccacatcgcctcctcccgcaccctcgacttcgaggcggccttcgccgaagtcgccggcgaccgcggcctggacgtcgtactgaacgcgctgtccggcgagttcgtcgacgcctcgatgcggctgctcggcgacggcggccggttcctggagatgggcaagaccgacatccgcgccgcggactccgttcccgacggcctctcctaccactccttcgacctcggcatggtcgatccggaacacatccagcggatgctgctcgacctcgtcgagctgttcgaccgcggcgcgctggccgcgttgccggtccgcagctgggacgtgcgccgcgccggcgaggcgttccgcttcatgagcctggcccagcacatcggcaagatcgtgctcaccgtgccgcaacccctcgaccccgacggcaccgtgctcctcaccggcggcaccggcggcctggccggcctgctcgcccgccacctggtcaccgagcacggcgcccgccacctgctgctggccggccggcgcggccccgacgcgcccggcgccgccgcactccacgccgaactgaccgccctgggcgccgaggtcaccgtcgccgcctgcgacgtcgccgaccgcaccgcgctcgccgcgctgctcgccaccgtgcccgccgaacaccccctcaccgcggtcgtgcacaccgccggcgtcctggacgacggcaccctcaccgccctgaaccccgaccgcctcgccaccgtcctacggcccaaggtggacgccgcctggcacctgcacgacctcacccgccacctcgacctggccgcgttcgtgctctactcctccaccgccggcgtcatgggcggaccgggccaggccaactacgcggccggcaacaccttcctcgacgcgctcgccgcccaccgacacgccctcggcctgcccgccacctcgctggcctggggcgcctgggagcagggcgccggcatgaccggcgcactgaccgaccacgacctgcgccgggtcagcgacgccggcggccaaccgctgctcaccgccgaacgcggcctcgccctctacgacgccgccaccgccgccgacgaacccctgatcgtcccgctcggcctcaccggcggtgcgctgcccgccggggtcggcgtccccgccgtgctgcgcggcctggtccgcaccgcgggccgccgggccagggccggcaccgccggcgtctcccgcgccggcctcgccgaacgcctcgccgccctgcccgaggaggagcgcacccccttcctcgtcgagctggtgcgcaccgaggccgccaccgtcctcggccacggctccaccgacccggtggacgcccgccgcgagttccgccaactcggcttcgactcgctgaccgccatcgaactgcgcaaccgactcggcaaggccaccggcctcaccctgcccgccaccctcatcttcgactacccgacccccgaccgcctcgccgtccacctccacgacgaactcctcggcgcggacgccccggtgaccgtcaccgccgccgcacaggccgcggacccggagcacgacccggtcgtcatcgtcggcatgagctgccgcttccccggcggcgtcagctcccccgaggagctgtgggacctggtggcatccggcaccgacgcgatcaccggcttccccgccgaccgcgcatgggaccgccacccgcagctcgccggcgcccccggcgcccgcaccggccagggcggattcctccgcgacatcgccgacttcgacgccgccttcttcggcatctcgccgcgcgaggccctggccatggacccgcagcagcgcatcctcctcgaagtcgcctgggaggccgccgagcgcgccggcatcgacccgcagaccctgcgcggcagcgacaccggcgtgttcatgggcgtcagcggccaggactacgccggcctcgtgatgcgctcccgcgacgacatcgccggccacgccaccaccggcctcgccgtcagcgtcgtctccggccgcctcgcctacgcgctcggcctggagggcccggccctgtccgtggacaccgcctgctcctcctccctggtgtcgctgcacctggccgcccaggcgctgcgcgcgggggagtgcaccatggccctggccggcggcgtcaccgtcatgaccaccgccgccaacttcaccggcttctcccggatgggcggcctcgcccaggacggccgctgcaaggcgttctccgactccgccgacggcaccggctggtccgagggcgccgccgtcctggtcctggaacgcctctccgacgcccggcgcgccggccaccgcgtactggccgtggtgcgcggctcggcggtcaaccaggacggtgcgtccaacggtctgacggcgcccaacggtcccgcccagcagcgcgtcatccggcaggccctggccaacgcgggcctgacccccgtcgacgtggacgccgtcgaggcgcacggcaccggcaccccgctcggcgaccccatcgaggcccaggccctgatcgccgcctacggcaccgaccgcgaccccgaacacccgctgctgctcggctcggtgaagtccaacatcggccacacccagtccgcggccggcgcggccgggctggtcaagatggtcatggccatgcgccacggcatcctgccgcagaccctgcacctcaccgaaccgtcctcgcacgtggactggtcggcgggcacggtgcggctgctcaccgagcggaccgcctggccgcggacggatcgtccgcgtcgggccggggtctcctcgttcggcatcagcggcaccaacgcccacgtcatcctggaacagccgcccgccgagcccacccccgccgccgacccgggccggcccgcacccaccgtggtggcctggcccgtctccgcgcagaccccggccgccctcgacgcccaactggaccggttgcgcaccgccgccgccctggcgccgctcgacaccgcccacaccctcgccaccggccgctcgctcttcgaacaccgcgccgtcctgctcgccaccgtcggcgacccggcgaccggcgcccccgacctgcccgaggtcgccaggggagcggcgacgccgcaccgcaccgcgttcctcttctcggggcagggtgctcagcggtcggggatggggcgtgaactgcatgctgctttcccggtgttcgcggcggcgttcgacgaggtggtggctgtgttggatgcggagctgggttctgatgctgatgggggtgtgtcgctgcgggaggtgatgtggggcggggggtcggagttgttggatcgaacgcgtttcacgcagccggcgttgttcgcggtggaggtggcgttgttccgtttggtggcctcgtggggggtggggcctgagttcgtggcggggcattcggtgggtgagattgcggcggcgcatgtggccggggtgttctcgttggtggatgcgtgtcgtttggtggtggcgcgggcttcgttgatggatgcgttgccggtgggtggcgtgatggttgcggtggaggcggccgaggcggaggtggtgccgctgttggtcgatggggtggcgatcgccgcggtcaacgggccggtctcggtggtggtctccggtgtggaggcggccgttgggcaggtcgtggatcagttggtggagcggggccggcgggtccgtcggttggcggtcagtcatgctttccactcgccgttgatggatccgatgttggatgccttccgggccgtcgccgagggcctggagtaccaccagccgcgcatccccgtggtgtccaacgtgacgggcgaggtggccgcggcggaggagctgtgcgcggccgactactgggtgcggcacgtccgggcgaccgtgcggttcgccgacggcgtccgcaccctggccgagcgcggcgccaccgccttcctggagatcggccccgacggcgtactgtccgcgctcgcccgcggcgtcctgcccgccgaggcgctcgtgacgcccaccctccgcaaggaccgcgacgaggagagcgccctgctcgccggactggcccggctgcacgtcgccggcgtgaccgtcgactggagcgccgccctgaccggcaccggcgcgcgcggcaccgacctgccgacctacgccttccaacgcgagcggtactggccggagttggccgccgaacccgcgggcggcggcgcggatgccgcggacgcggagttctgggccgcggtggagcgcgcggacgccaccgcgctcgccgcccacctggacatcgacggcgaccagctcggcgccgtgctgcccgcactgtccgcctggcgcacccggcgccgcaccacatcggccaccaacgccctgcggcaccgggagagttgggaaccgctgtcgctcgccggcacgccgcacaccggcggcgtcctggtgctggtgcccgccgccgcgaccaccgacccctgggtcgccgacgtcgtcgccgccctcggcccggacgcccgccgggtggacgtcccggccgacggcaccgaccgggccgcgctcgccgccctgctcaccgaagcggccgacgacaccgccccgaccgccgtggtctccctgctcgcgctcgacgagaccagcggcgacgacgcggtaccggccggcaccaccgccaccgccgcgctcgtccaggccctcgccgacaccggcgccccggccccgctgtgggccctgacccggggcgcggtcgccgcgctccccgacgagcagccgaccgcccccgcccaggccgccgtctggggcctcggccggatcgccgccctcgaactcccgcgccactggggcggactggtcgacctgcccgccgacctcgacgagcgcaccgcacgccgactgcccgccgcactggccgacgccggcgacgaggaccagctcgcgctgcgggccaccggcgcctacggccgccggatcaccccggcgcccgcccccgacgacgcccccggcaccgggtggcagccgaccggcaccgtcctgatcaccggcggcaccggcgcgctcggccggcacaccgcccgctggctcgccgcccacggcgccgagcacctgctgctgctcagccgcagcggccccgacgcgcccggcgcggccgaactcaccaccgaactcaccgccctcggcgcccgcgtcaccctcgtggcctgcgacgccgccgaccgggagcagctgaccagggtcctcgccgaggtaccgcgggactgcccgctgaccggcgtggtgcacaccgccggagtgctcgacgacggcgtgctcaccggcctcaccccggaccggttcgccacggtcttccgcgccaaggtggcctccgccgtgctcctcgacgagctgacccgggacaccgacctggccgtcttcgcgctgttctcgtccgtcgcgggcgctgtcggcaaccccggccaggccggctacgccgccgccaacgcggtcctcgacgccctcgccgcccgccgccgggcccagggcctggccggcacctcgatcgcctggggtgcctgggccggcgacggcatggcggcccgtcacacccgccccggcgccgaacccgtcggcctgctcgaccccgacctcgccgtaccggccctggcccgcgcggtgacggagccccagcccaccctcgtcctcgccgacctccagcagccgcggctgctggaatccctgctggcgctgcgccccagcccgctcctgagccggctgcccgccgcccgcaccgcggcccgcgcggtccaggaagcggaccgccgccgagccggcgccgcggccgacctgcgcgaccaactcgccggcaccgcacccgccgaccgccacgccgtcctcctccgcctggtgcggaccacggccgccgcggtcctcggccacaccggtgccgacgccatccgggccgacaagcccttccgcgacctcggcttcgactcgctcaccgcggtggaactgagcagcgctctcgccgccgccaccggcctggccctcccgcccagcctcgtcttcgaccacccctccccgcgggcgctcgccgaccacctgcgcgccgaactcaccggcgaccggccggaatccgcccccgcggccccgccggcaccggtccccgccgcggacgacgatccgatcgtcgtcgtcggcatggcctgccgcttccccggcggcgtcaccacccccgaggagttctggcagctgctcgccgagggccgggacggcatcgacgcgttccccaccgaccgcggctgggacctcgacgtgctcggccggcgacggccagggccacagcgcccaccgaggtcggcggcttcctcttacgacgcggccgccttcgaccccggcttcttcgacatctccccgcgcgaggcgctcgccatggacccgcagcagcggctgctgctggagaccgcctgggaggccgtcgaacgcaccggcaccgacccgacccggctgcgcggcagccgcaccggcgtgttcgtcggcaccaacggccaggactacgccggcctcgtcctgcgcgcccaggaggacgtcgaggggcacgccggcaccggactggccgccagcgtgatctccggccgcctcgcctacgccttcggcttcgagggccccgccgtcaccgtcgacaccgcctgctcctcctcgctcgtcgccctgcactgggccgtccaggcgctgcgcgcgggggagtgctccctggccctggccggcggcgtcaccgtcatgacgacctcgacgagcttcgccggcttcacccggcagggcggcctggcgccggacgggcactgcaaggcgttctccgactccgccgacggcaccggctggtccgagggtgtgggcgtcctcgtcgtcgaacgccgctccgacgcgctccgcaacggccatgagatcctggccgtggtgcgcggctcggcggtcaaccaggacggtgcgtccaacggtctgacggcgcccaacggtcccgcccagcagcgcgtcatccggcaggccctggccaacgcgggcctggcccccggcgacgtggacgcggtcgaggcccacggcaccggcaccgtcctcggcgaccccatcgaggcccaggcgctgctcgccacctacggccaggaccggcccgccgaccggccgttgtggctcggctcggtgaagtccaacatcggccacacccaggccgccgccggcgccgccggcctgatgaagatggtgctggccctccaacacggcacgctgccgcgcaccctgcacgtcaccgagccctcgacccgggtcgactggtcggccggcgcggtgcggctgctcaccgagcggaccgtctggccgcggacggatcgtccgcgtcgggccggggtctcctcgttcggcatcagcggcaccaacgcccacgtcatcctggaacagccgcccgccgagcccacccccacggcccctgccgaccgccccacccggacgcccgccgtcctcccatgggtcgtctcggcccgatcggccaccgcgctcgacgcgcagctcgcgcgactgcgggcgttcgccgccgagcgcccggacctgccgcccgccgacgtcgcccactcgctcgtcaccagccgcgccaccttcgaacaccgggcggtcctgctggccgcgcccgacggcatcaccgcggccgcccgcgccgaggcccgcgaacgcagcaccgcgttcctcttctcggggcagggtgctcagcggtcggggatggggcgtgaactgcatgctgctttcccggtgttcgcggcggcgttcgacgaggtggtggcggtgttggatgcggagttggcgacgggttccggtgggggtgtgtcgctgcgggaggtgatgtggggcggggggtcggagttgttggatcggacgcgtttcacgcagccggcgttgttcgcggtggaggtggcgttgttccgtttggtggcctcgtggggggtggggcctgagttcgtggcggggcattcggtgggtgagattgcggcggcgtatgtggccggggtgttctcgttggtggatgcgtgtcgtttggtggtggcgcgggcttcgttgatggatgcgttgccggtgggtggcgtgatggttgcggtggaggcggccgaggcggaggtggtgccgctgttggtcgatggggtggcgatcgccgcggtcaacgggccggtttcggtggtggtctccggtgtggaggcggccgttgggcaggtcgtggatcagttggtggagcggggccggcgggtccgtcggttggcggtcagtcatgctttccactcgccgttgatggatccgatgttggatgccttccgggccgtcgccgagggcctggagtaccaccagccgcgcatccccgtggtgtccaacgtgacgggcgaggtggccgcggcggaggagctgtgcgcggccgactactgggtgcggcacgtccgggcgaccgtgcggttcgccgacggcgtccgcaccctggccgagcgcggcgccaccgccttcctggagatcggccccgacggcgtactgtccgccctggccgcggcctgcctgttcgacacggacgccgaagtggtgcccgcgctgcgcaaggggcgccccgaggagcacaccgccctcaccgccgccgcccaactccacgtggccggcgtggacatcgactggaccgcggtcctggccggcaccggcgggcggcggatcgccctgcccacctatgccttccagcgcgagcggtactggccctcgctcgccgcacaggcccccggcgacgccggcgggctcggcctggaagccgggcggcacccgctgctcggggccgcgaccaccgtcgccggatccgcggagatcctgctcaccggccgcctgtccaccaccgcccagccgtggctcgcggtctacgaggcggacggccgcaccgtcctgccggccgcggtcctcgccgaactcgccgtccgcgccggcgaccaggccgactgcccgaccgtggcggaactgaccgtcgccgcaccgctcgtcctcaccggcgcggcggcccagcgcctccaggtccgggtggccgcccccgacgacaccggccggcgcgcgctgtccgtgcacgcccgacccgacgactcccccgacagcccctggacgctgcacgccaccgcggtcctcacccacgacaccccgcagcccccggcgccggacaccggctggccgccggagcgcgccgtgccgctcgacgccctgcccaccgccaccggcccggcccggatcgcggcggcctggcagtggggcgacgaactctgcgccgagatcgaactccccgaacccggcccggcggagcgggcattcgccctgcacccggcgctgctggacaccgcggtccgcgccggcggcctgctggacggcgacgccaccctggacgccctcggctggcggggcctcgccctgcacgccgcgtccgccaccgccctgcgggtccgcctcaccccggacggcacggacacctgggctctggaggccaccgacccgcagggcgctccggtcgtctccgtcaccgggctcaccctgggcacgcccaccgtcgaccggtcgggggccggggcggccgatgacggcgcgaccctgctcgacctggagtgggtgcccgcgccgcaggccgcgcccaccggcggcgaccacctcccgtacgccgtgctcggcgatcaactcgcggagctggacgggcagttgaggatcgcgggcgacgggcccgggcgcgtcgcatcgctggccgcgctgctggacggcggtgcgccgctgccccggctcgtcctcgcgccggtgctgggcgtgccgaccggggaaggcgacctgcccgccgcggtgcgcggcaccaccacggcggtgctggagctgctgcagcgctggaccgccgacgcccgcaccgccgacagccacctggtgatcgtcacccgcggcgccgtcgccgccggggcggaggacgtgcacgacctggcggcggccccggtctggggcctggtccgctcggcacagtccgaacaccccggcagcttcctgctgctcgacctcgaccccgccgatcccgcgggagcctcccgcgccgccgcgccggccaccctggcggccctgctcgacgcgggcgagacccaggccgcggtgcgcgccgacacgctcaccgtcgcccggctgacccgggccgccgacggacccgaggccaccgccggacacccggtgcgggactgggaccgcgacggcaccgtcctgatcaccggcggcaccggcggcctgggcggcctcctggcccgccacctggtcaccggacacggcatcaagcacctgctgctcgccgggcgccgcggcccggacgcccccggcgcgcgggccctgcgcgacgaactggccgccctcggcgccgaggtgaccgtcgccgcctgcgacgtggccgaccgtgccgcactggaccgactcctcgcgcaactgccgccggagcacccgctgaccgccgtcgtgcacaccgccggcgtcctcgacgacgccaccgtcggcaccctgacgcccgagcggctggacaccgtcctgcgcgccaaggcggacgccgcctggcacctgcacgacgccacccgcgaccgcgacctggcagggttcgtgctgtactcctcggtcgccggtgtcaccggcggccccggccagggcaactacgccgccggcaacacgttcctcgacgcgctcgccgcgcaccgcgccgcccagggcctgcccggactgtcgctggcctggggaccgtgggggcaggacgccggcatgaccggcaccctcggcgccgccgacctggcccgcctggagcgctccggcatgccgccgctcaccccggaacagggcctggccctgttcgacgccgccggcgcccgcggcgacgggttcgcggtggcggtgcggctcgcccgtggcgccgccgcaccgggcgccgacgaggtccccgcggtgctgcgtgccctggtgcgcggccggcgccgcacggcggccgcggccgggcacgccggtgtactggcccgccggctggccgccctggacgccgagcagcggcatcaggcgctgctcgacctggtccgcaccgagacggccgcggtgctcggccactccggggcggacgccgtcccggccgagcgggacttcaaccggctgggcttcgactcgctgatggcggtcgaactgcggacgcggctggccaccgccaccggagcccggctgccggccacgctcgtcttcgaccacccgacgccggacgcggtcgcccggcacctcgcgtcgacgctgcccggtgggaccgcggccggtccggaccgttccccgctggccgaactcgaccggatcgccgccgagttgtcgccggagggcgcggacgacgccacccgacagggcgtcgtcgggcggctgcggcacctgctggcgcagtgggacggcacccgacaggacggcggtgggacgaccgtcgacgaccgcatcgaagcggcgagcgccgaagaggtcctcgccttcatcgaccacgagctcggccggcaggcggactcctgacccgccccactcccgtcgctcgcgcgcaccacatctgaggaaggtttcacggaccatgccggacgaaaagaagctcgtcgactatctgaagtgggtcacgaaggacctccaccagacccgccagcgccttcaggaggtggaggcggggcgccacgaacccgtggcgatcgtcggcatggcctgccgcttccccggcggtgtgcgctccccggaggacctgtgggagctgctgtccgcgggccgggacggcatcgggccgttccccgccgaccgcggctgggacctggcggcgctggccggcgacgggcccggtcgcagcgccacccaggaaggcgggttcctgcccgacgcggccgccttcgacccgggcttcttcgacatctccccgcgcgaggcgctcgccatggacccgcagcagcggctgctgctggagaccgcctgggaggccgtcgaacgctccggcatcgacccggccgggctgcgcggcagccgcaccggcgttttcgtcggcaccaacggccaggactacgcgcacctggtcctcgccgcgcaggacgacatgggcggctacgcgggcaacggcctggccgccagcgtgctctccggccgactggccttcgcgctcggcctggaaggcccggccgtcaccctcgacaccgcctgctcctcgtcactggtgaccctgcacctggccgcacaggccgtgcgcgccggcgaatgcggcctcgccctggccggtggcgtcacggtcatgacgacctcgtcgagcttcgccggcttcagcctccagggcggcctggcgccggacggccgctgcaaggcgttcgccgaggcggccgacggcaccggctggtccgagggcatcggcctgcttctcgtcgagcggctctccgacgcgcagcgcaacggccacccggtgctcgccgtgctgcgcggctccgccgtcaaccaggacggcgcgtccaacggcctcagcgcgcccaacggtccgtcccagcagcgggtcatccgccaggcgctggccggcgccggactcgtccccggcgacgtggacgcggtcgaggcgcacggcaccggcacccggctcggcgaccccatcgaggccggtgcgctgctcgccacctacggccaggaccggcccgccgaccggccgttgtggctcggctcggtgaagtccaacctcggccacacccaggccgccgcgggcgtcgccggcgtcatcaagatggtgctggccctgcggcatggcgtcctcccgcagaccctgcacgtggacgcgccctcctcgcacgtcgactgggagagcggcgcggtgcggctgctcaccgcacccgtcgcctggtccgagggcgacgaccgggtgcgccgggccggcgtctcgtcgttcggcatcagcggcaccaacgcccacgtcatcctcgaacaagcccccgatcagccggaaccgaccgcggaagagacggctgccgcggcgcccggcggcaccgccgaggagcgggccgccgctcccgtcgccccgcgcgccgtgccgtggccggtcgcggcacgcaccgccggcgccctcgacgcccaactggtccgggtccgcgcgctgaccaccgcgcccggccgcaccgccgccgacgtcggtcacgcgctggccaccgcccgtacccccttcgagcaccgggcgctgctggtccacgagggcggcgccgtcaccgaggtggcgcgcggcgccgtccccaccggtgaccggggcgggctggccgtgctgttctccggacagggctcccaacggccgggcatggggcgcgaactccacgcccgctacccggtcttcgccgccgccttcgacgagaccgtcgccctgctcgacgcccggctcggcacgtcgctgcgcgacatcgtctgggaccaggaccgcacccggctcgacgacacccgccacacccagcccgcgctgttcgccgtcgaggtcgcgctgtaccgcctgctggcctcctggggcatccggcccgaccacgtcaccggacactccatcggcgagatcaccgcggcgcacgtcgccggtgtgctgaccctcgcggacgcctgcaccctggtggccgcccgcgccaccgccatgagcgaactgccgcccggcggcgccatggtggcgctggaggccaccgaggacgaggtgcgtccgctgctcaccgacgacctcgcgatcgccgcggtcaacgccccccggtccgtggtcgtcgccggcgccgaggacgccgccctcgccgtccgccggcacttcgacgacctgggccgccggaccacccggctcccggtcagccacgccttccactcgccgctcatggacccgatgctcgacgccttccggacggccctcgccccgctgaccttcgccgagccggagatcccggtcgtctccaacctcaccggcctcccggccaccgccgaggaactcgccaccccgcactactgggtgtgccacgtccggcaggccgtccgcttcggcgacggcgtgcgcgccctcgccgaccgcggcgtgcggaccttcctcgaactcggcccggacggcgtgctgtccgccctggtccgggagaacctccccgagccgggcctggtcgccgtgcccgtgctgcgcaaggagcggcccgaggagaccaccgtgctggccgccctgggaaccctgtgggcgcacggcgcggacgtggactgggacgcggtgttcgccggcacccgcaccccgcaggccgaccccgtcgagctgccgacgtacgccttccaacgcgcccgctactggcccaccctcggcgcccgccacggcgacccggccgacctcgggcagaccgccgccgcccacccgctgctgggcgccgccgtcaccctcgccgacgccgacgagaccgtgctcaccggccgcctcgcgctgccctcccacccctggctcggcgaccaccgcagcgacggccggatcaccgtccccggcgtcgccttcgccgaactcgccgtccgcgccggcgacctgagcggcaccccgcacctggcgcggctcgacctgccggcgccgctcaccctcggcgacggcgacaccgtcaccctccaggtccgggtcggcgcccccgaccccgcgggccaccggccgctgaccgtccacgcccgcctcgcagccaccgaggacgccccctggaccacctgcgcgaccggtctgctcgccccggacgcccccgaagcgcccgcggatccgatcggcccggccgacgccgggtggccgccgcgggacgcccgcccggtgcccgtcgccgacctcgacgcggccgccaccgccgcaggccgccactacggcccccatttccagggcctgaccgggctctggcggcgcgacggcgaggtcttcgccgaggtggccctgcccaccgccaccgccgccgaccgcgccttcggcatccaccccgcgctgctggccaccgcgctccgcgccaccgccgcactggacgacgaccacaccgccggccacacccccgaaccgaccggcatcaccggactcgccctgcacgccaccggggccaccgcactgcgggtccggctcaccgcgaccgggcccgacaccgtggccctcgccgccgcggacgccacgggcggcgcggtcctgaccgccgacaccgtcaccctcggctccccgcaggaccgcccggctcccgcaccggccggccacaccgggcagggcggcctgttccacctcgactgggtgccggtcgaccccggcagccgagccaccggcacccgctgggccgtcgtcggcgacgacgaactcgacctcggctacgccctgcaccgcgccgacgagacggtcagtgcctacgcggcgtcgctgggcggagccatcggcgacagcggtctggcgcccgacgtcttcctcgtccccgtcgtcggcggcccggacgccgggcccgacgcggtgcacgccgtcaccgcccgcgccctggggctgctccaggagtggctgaacgagccgcggttggccggcgcccgcctggtcttcgtcacccgcggcgccgtcgcggtgcccggcgagaccgtcaccgacccggccggcgccgccgtctggggcctgctgcgctccgcccagaccgagaacccgggcagtctgctgctggtcgacctcgacgacgcgttccggtccgccgggatgctgccgcacgtcctcaccctcgacgaacagcagctcgtcgtccgcgaccacgcggtccgcgccgcccgcctggcccggctgccggagccggccgccggcaccgcgccggcccgcgcctgggacccggacggcaccgtcctgatcaccggcggcaccggcggcctgggcgccgcgctcgcccgccacctggtcaccgtccgcggcgcccgccacctgctgctcgccggccgccgcggccccgaggcgccgggcgccggcgaactggtggcggagctgaccgcacagggcgcggacgtgcgggtggccgcctgcgacgtcggcgaccgcaccgccctcgacgcgctcctcgccacggtccccgcggcgcacccgctgaccgccgtcgtgcacaccgccggcgtcctggacgacgccctgatcggctcgctcacccccgaccaactggccaccgtgctacggcccaaggccgacgccgcctggcatctgcacgacgccacccgcggcctcgacctggccggcttcgtcctgtactcctcggtctccggcgtcctgggcagccccggccagggcaactacgccgccgccaacgcctacctcgacgcgctcgcccggcaccgcgccgaccagggcctcccggcgctctccctcgcctggggcccctggggtcggggcagcggcatgaccgcgtcggtcagcgacgccgacctggagcggatggcgcgcggcggcctgccgccgctgaccgtcgaggacggcctggccctgttcgacgccgccgtcggccgccccgagccggccctggtgcccagccgcatcaacgtcgccggcctgcgggaccagcaggcactgccggcactctggcgcgacctggtaccgcgggcccgccgcaccgcggccaccgccgaccgctccccggtcacggtgcgcgagcgcctccgccacctcgacgagaccggccaggagcagctgctcatcgacctcgtcgtcggctacaccgccggcctgctcggccaccccgaccccaccgccgtcgatcccgaacggggcttcctggagctgggcttcgactccctggtctcggtcggcctgcgcaaccagctcgccgagatcctcggcctgcgcctgccctcgtccatcgtcttcgacagcaagtcgccggtgaagctggcgcgttggctgcaccaggaactcgccaacggcccccagccgggcgccaccggccccgccgccgcggacgcccgtcccgcggtgcgctccgacgacaccctggagggcctgttctacaacgcggtgcgcggcggcaagctcgtcgaggcgatgcggatgctcaaggccgtcgccaacacccggccgatgttcgacacccccgccgagctggaggagctctccgagccggtgacgctcgccgacggcccgggccggccccggctgatcttcgtcagcgccccgggcgccaccggcggcgtccaccagtacgcgcgcatcgccgcgcacttccgcggcagccgccatgtctccgcgctgcccctgatgggcttcgcccccggcgagctcctcccggccaccagcgaggccgcggcccgtatcgtcgccgagagcgtcctgatggccagcgagggcgaaccgttcgtcatggtcggccactccaccggcggctcgctggcctacctcgccgccggcgtcctggaggacacctgggacgtccggcccgaagcggtggtcctcctcgacaccgcgtccatccgctacaaccccggcgagggcaacgacctggaccgcaccacgaggttctacctggccgacatcgactcgccctcggtgacgctcaacagcgcccggatgtccgccatggcccactggttcatggcgatgaccgacatccaggcgcccgcaccgaccgcccccaccctcctcgtgcgcgccgcccgggccctcgacggcttccggctcgacacctcgtccgtccccgccgacgaggtccgggacatcgacgccgaccacctctccctcgccaaggagcactcggcactgaccgcgcaggccatcgagggatggctcgcggaactgccggaccccgcggcctgatctccggcccggccggcccccgacaggccgggcccatccccccaccggggcggcgccacccaggtgcgccccggcgcacccggccccgcgcaggcagccggagcgcccatccccccgcatggcaccaccctccagaggagtccttccatgagcacaccgaccgcaccgccctccctgaaagcggaggtgccgcccgtcctgcgcctgagcccgctgctgcgcgaactccagtcccgcgcccccgtctgcaaggtccgcacccccgccggcgacgagggctggctggtgacccggcacaccgaactcaagcagctgctgcacgacgaccggctggcccgcgcccacgccgacccggccaacgccccgcgttatgtgcacaacccgttcctggacctgctcgtcgtcgacgacttcgacctggcccgcacgctgcacgccgagatgcgctccttgttcaccccgcagttctcggcccgccgcgtcatggacctgacgccgagggtggaagccctcgccgagggggtactggcccacttcgtcgcccagggaccgcccgccgacctgcacaacgacttctcgctgccgttctccctgtcggtgctgtgcgcgctcatcggcgtcccggccgaggaacaggggaagctgatcgccgccctcaccaaactgggcgaactcgacgacccggcacgcgtccaggaaggccaggacgagctgttcggcctgctgtccggcctggcacgccgcaagcgcatcacacccgaggacgacgtcatctcccggctctgcctgaaggtgccctccgacgagcgcatcggcccgatcgcctccggtctgctcttcgccggcctggacagcgtcgccagccacatcgacctgggcacggtgctgttcatccagcacccggaccagctcgccgcggccctggccgacgagaagctgatgcgcggcgccgtcgaggagatcctgcggtccgccaaggccggcggttcggtgctcccgcggtacgcgaccgccgatgtaccgatcggcgacgtgaccatcagggccggcgacctggtgctgctggacttcaccctggtgaacttcgaccgcacggtcttcgacgagccggagctcttcgacatccggcgcgcccccaacccgcacctgacgttcggccacggcatgtggcactgcatcggcgcgccgctggcccgggtcaatctgcgcaccgcctacaccctgctgttcacccgcctgcccggcctgcggctggtgcgcccggtcgaggaactgcgggtgctgtcggggcagttgtcggccggcctgacggagctgcccgtcacctggtgacgtgatgtcggacccgcccggcccggttccgggcaggcggaagtgagggcccccgccccgctcggccgggggccctcacgcacgggggagcgggctcctcagtccgccgcgacgctgatcgccccggacgggcagagcgccgccgcgtcgcgtacgtcgccgggatccgcggcgtccgccgccccggccaggacggtcaccagaccgtcgtcgtcctggtcgaacaggtccggtgcggtcaggacgcactggccggccccgacacagcggccggggtccacggtgatgcgcacgatcgttcctccgagggtcggttcgtcgccggggtcgggccgccgccgggcggcccgaccgggctcacttccaggtgacgggcagttcgtgcaggccgaacagcaccccgtcgtacttcaacggcagttcctccaccggcacggcgagcgtgagggaggggatccgggcgaagagcgtgcggtaggcgatgtccatctcctcccgcaccaggttctggcccaggcactggtggacaccgtagccgaacgccacgtgcgagcgcgccgagcgctcggggtcgaactccgagggcgccgcgaaggccgtggcgtcgtggttggcggcggcgatcagcggcacgatgccctcgccggcccggatcagctgaccgccgatctccacgtcctcgacggccacccggaatgccaccagatcggccaccgagtagtagcgcagcagttcctcgacgatccggtcgtcgccgatccaccgcgggttggtgagcaactgcaccacgcccaggccgatgttgttcgccgtcgtctcgtgcccggcgatcagcagcagcatcgccaccccggacagctcctgccgggacagtgtgcccgcggcgatcagccggctgatcaggtcgtcaccgggtcgccgctgcttgatctggatgagtcggcccagatagcgcagcagcgcctgggtcgccttgtcgcgctcctcgtcggtcgaactgagccggaccagcacccgggtccggtcctcgaagaagtcccggtcgaccttgggcaccccgagcagactggagatcaccagggacggcaccggcagcgcgaaggactcgacgaggtccgccgaggtgcccgcggccagcatcgcgtcgatccgctcgtccacgatctgctggatcaccggccgcagttcccgcaccttgcgcacggtgaactcggggatcaaggtcttgcggaaccggccgtgctccggtgggtccatcgccacgaaccaccccggcacctcgtactgcgacggggccccaccggtccgaccggccttggggaaaccgggtttggaggggtcggcgctgatccgggggtcggtcagcaccgcccggacgtcctcgtgccgggtcaccaaccagaccgggccgctggggagttcggagcggaccaggcccgccccgccgcggtaggtcgcgtactccggcggggggaagggccggcccggcctgcgcagcgggaaggccaccgggcactgcggcgcggcggtccgcgcgtcggcttcggtgctcatgccactccgtagaacgcgcggatccggccggtgatgaactcctgctcctgtgcggtcagtccggtgtgcgtcggcagatagaagccgtcggcgctgagccgggccgcgttcaacgcgggccagtcggcggagaagtaaccgggctgacggctcatcggcttgaagaagacccgggtctcgatgccctcgccggcgaggtacgcgcacagctcgtcccgccgctcggcccgcaggtcgtacatccacagcacgtcgcgcggcggcatcagcgtgatgccggggatgtcgcgcagcgcctcgtcgtagcgcttctcgatgtcgcggcgcagggcgaggatggtgtccagctgctcggtctgcgcgagcgccaccgcggcctgcatgttggtcatccggaagttgtaggccagcttcttgtgcaggaagctgtggtccttggtgaacgccatcgcccgcagatgggccatctgctcggccaggtgcgggtcgtgggtcaggcagacgccgccctcgccggccgagatgatcttgttggcgaagagcgagaaacaggcgatgtcgccccgcggccgcaccccgtgcgcctcggcggagtcctccaccacccgcaggttgtactcgtacgccaggttcagcacggcgtccatgtcgcactgccggccgtagatgtgcaccggcatgatcactttggtgcgcggggtgatcttctcctcgatgcgggacacgtcgatgttcaggtcgtcgccgcagtccacgaacaccggcgtggcaccggtgtaggtcaccgcccaggcggacgcgatcatcgtgaactccgggacgatcacctcgtcaccggggccgacgcccagcgcgcgcagcgccagcgtcagcgccgtggtgccggaggagcaggcgacgccgaacggcacgtcgttgtacgcggcgaacgcctcctcgaaccgcctgacgtacggcccctgcgaagagatccagccgccgccgacggcctccgtcacatagtcgagctcgcggccctggagccacggcatggacaccggatacgtaaaggacatgggttttgagtcttcctcggtcagtcggttgccagggcgggaaggccgagcagcaggtccgccgccgcggcccggccgccggcgtcccgcagcagcccggcgaagtgctccgcgcgctcggtgaaggagggttggtcgagcacgcgggtgatcttgtccaggacgtcctcggtgtccacggtctccggccggtccagggtcaggctcaccccgaagtcctggccccggatcgcctggtcgtcgcagtccacccacaacggccggaccaccagcggctttccgaagtacaggccctcgtggtagccgttgccaccggcatgggtgaagaacgccttcacgttcggatgggccagcacgtccagctgcgacggcacccagccctcgatccgcaggttgtccggcagctcggcggccggcggcagcaactcctgttggccgcgcgggagtttccacaacacctggtggccccggccgtccagtcgccgggcgacctccaccagcgacgccacctgctcacgggtcagccgggtgatcgtgccgaagcccatgtacaccacggacttctgcgccgacagccagtccgacaggccgtcgtcgtccggtgcctggggcagcggcggcaccatcgtgcccaccagccgcagcttcggatgcatcgggaacgggtagtccaactcccttacggagtagcacaagacctgctccgcatggtcgatccgcgccatcatctgccgcgcctggggcgcgatgcccagctcggtgcggacccggttgtcctcctcgacgaccttgcggacgtccgacgtcaggaacatcccgagcgtccgcagccggaacagctggttctcgatccgctgagccagggacatcgcggccggcagccccgagtgcggcaccgggaaacccgacggggtgtaggacttggcgaacgggacgtgcgaggtgaggacgttgctcggcacgaacggcaccccgagcacgaacggaatgcccttggtgatcgccagctcgtacccgaactggcacatgctctcgatcaccatcagcgccggctcgacctcctcgacgatctcctccaggcggcggtacttcgccatccgcgactccggcgcgaacgaatgccgaatcaccgccgcgtgcgccttgaaccgcgaccgctgcgtcacctccgcatacgtcgcgtcgtcccatgtgaccgccgacatctgcgagacggtgtcgccgagcgacgcgaaccgaaccgggctgccgtccaccacggccgccacctcgtcgcgcgctttctcgtcggtggcgaaccacaggtccgccacgtcgcgccgggacaattccccggccagcacgagcagcggattgagcaggccgctttcggcataactgacgaacaggatcggccgccgattcgcgcccatggacaacacccctcggaatgtggcgggccgccgggcccgcgcgccacgcacccgcccggcccggtcgccgggtgagtgcattcgccgacgccgccacccgaggcgcgtgttgccggaaggaagggtcaccggccggcacccggaacgcgccgcgtggaaaacgggtcggttacttggtctcatgccacggaccggggaatcactagtcttcggcgcgcgacggccctttccgggccgtgtggccaatgcccgtccccggcgcccgtcattccttagggaaaagtacagcgtttgcgaacgtacgatccggcacgcagaggtgacctgaggccaacttttccgcaggggtgagcaaggcatgacgatcggagccgacgaggacccggtggtggtcgtcggaatggcctgccgttatccgggtggggtcgccggcccggaggacctgtgggaactggtccgcaccggccgcgacgcgaccaccgccttcccggacgaccgcggctgggacctggccgcactggccggcgacggacccggccgcagcgcgacccgcgagggcggattcctcaccggcgccgccgacttcgacgccgccttcttcggcatgtcgccccgcgaggccgtctccaccgacccgcaacagcgcctcgtcctggagaccgcctgggaagccctggagcgcgccggcatcgacccgcactccctgcgcggcagccgcaccggggtcttcgtcggcgccagcggccaggactacgccgccgtcacccacgcctcgcccgacgacctggacggacacgccctcaccggcctggcccccggcgtcgcctccggtcgcctggcgtacgtcctgggcctcgaaggccccgccgtcaccgtcgacaccacgtcctcctcgtcgctggtcgcgctgcactgggcggtccgcgccctgcgcgcgggggagtgcagcaccgccctggccggcggcgtcacggtgatgtccaccccggccgccttcgtcggccacacccgacagggcggcctcgcgcccgacggccgctgcaagccgttctccgacgacgccgacggcaccgcctgggcggagggcgtcggcatcgtcgtcctggagcacctgtccaccgcccgcgccgccggcaaccccgtcctcgccgtgctgcgcggctcggccgtcaaccaggacggcgcctccgacggcctcaccgcacccagcggtcccgcccaggaacgcgtcatccgcgccgccctcgccgacgcccgactcgcccccgccgacatcgatctcgtcgaggcgcacggcaccggcacccggctcggcgaccccgtcgaggcccgggcgctgctcgccgcctacggccaggaccgggacccggaccgaccgctgcgcctcggttccctgaagtccaccctcggccacgcacaggccgccgccggcatcggcggagtgatcaagaccgtcctgaccctgcggcacggcctgatgccgcgcatccggcacctggccacccccacccgccaagtcgactggtcccagggcgccgtggcccccctcaccgaccacacgccctggccaccggccgaccgaccgcgccgcgccggcgtctcctccttcggcatcagcggcaccaacgcccatgtgatcctcgaagaggcgccgcccgccgacgtccccgtcacccggcccggcaccctccgccccagcaccgtcccctggccggtctccgccgccacgcccgaagccctcgacgcccaactcgcccggctccgcgcccacctgcgcacccactcggacctggacccgctggacgtcggctactccctggccaccggccgcgccgcgctccgccaccgggcggtcctcctgccgcccgccgacggcaccgccgcggacgccgtcgagcacgcccgcggtgcggcccaccagcgccgcaccgccgtcctcttctccggccagggcagccagcgcccgggcatgggccgcgaactcgccgcccgcttcccggtgttcgccgacgcactggacgacgcgctgcgcgccctggaccggcacctggacggcccggtgcgcgaggtgatgtggggcaccgacgccgcgctcctggaccggaccggctggacccagcccgccctgttcgccgtcgaggtcgccctccaccgcctggtcgcgtccctcggcgtcacccccgacttcgtcggcggccactccgtcggcgagatcgccgccgcccacgtcgccggcgtcctgagcctggaggacgcctgccgcctggtggccgcccgcgccacgctgatgcaggcgctcccggccggcggcgcgatggccgcgctggaggccaccgaggacgaagtggccccgctgctcggcgcacacctcgcgctggccgccgtcaacggccccaccgcggtcgtcgtcgccggagccgaggacgccgtgcggcaactgaccgcccgcttcgccgaccgcggccggcgcaccagccggctggccgtctcgcacgccttccactcgccgctgatggagcccatgctcgacgccttccgggacgtcgtgagccgactgaccttccaccagccgtcgatcccgctggtctccaacctcaccggtgaactcgccggcagtgagatcaccagcgccgagtactgggtccggcacgtccgcgacaccgtccgcttcgccgacggcatcaccgcactggccaaggccggcgccgacgtcctgatcgaactcggccccggcggcgtgctgtccgcgatggcccgcgacaccctcggccccgacagcaccaccgacgtcgtccccgccctgagcaagggacggcccgaggagaccgccttcgccggcgccctcggccgcctgcacaccctcggcgtccccgtcgactggcccgccttctacgccggcaccggcgcccgccgcgtcgaactgcccacctacgccttccagcacgtgcgccactggcccaccccgccccgcccgaacggcgccgggcccggcgccctcggccaccccctgctcggctccgccgtcgaactcgccgacggcggcggcaccgtctgctccggcgccctctccctccgcacccacccctggctcgccgaccacaccgtcgccgggcgggtcgtgctgccggccaccgcgctgctggaactcgccgtgcgcgccggcgacgaggcgggctgcgacgtcctgcacgaactccacctcaccaccccgccggccctgcccgacgacgccgccctgcacgtccaggtgcacgtcggccccgccgacaccaccgggcgccgcgccgtcaccgtccacacccgccccgaccaccacccggccggcgactggacccgatgcgccaccggcaccctcggcagcaccccgccgtccgcagccgaagccgccacgggcggcaccccggccgcctggccgccggccgacgccgaacccctcgacctcgccgaccactacgaacggctcgccgaccgcggcttcgactacggcccgaccttccgcggcctgcgggccgcctggcgacgcggcgcggagatcttcgcggacgtggaatgcccgcccggcaccgccgacgacgcccccgaccacggactgcaccccgccctgctcgacgcggcccggcacgccgccatggcggtggacggcaccgtgcccgtcgcctggcacggcgtccggctgcacgccgtcggcgccaccgcgctgcgggtccgcatccgccccaccacgaccggcacgctgaccctcaccgcggtcgacgtgcacggcgcgccggtcgtcaccgtcgaggccctcaccgcccgcccgctgaccgacgaggaacgcgccgccccgcggacgccgcggcaggcccgcggcgagacgcccgccgacgcccgcccggcccggcccgcggcggcccgccccggcccggccggcgaacccctcccggacaccaccgggtcccaccccaccgccggccacctcgccgcgctgccgccggccgcccgggagcgccagctgctggacctggtgcgcacccaggccgccgccgtcctgggccaccccggccccgaggccgtcggcacccgcagcgtcttcaaggagctgggcttcgactcgttggccggcgtcgaactcgccgaccggctcaccgcccgcaccggactgcgcctgccggccaccctcgtcttcaacttccccacccccgaacgtgctgcccaccgcctcggggaactcctcgccgcaaccgcccccctcgaccccggggcgtacggagaggaactcaccaggttcgaggcgatcgtgacgaacctgccgcaggacggccccgaacgccgggccgtcgcggaccggttggacgccatcgtctccgcactccgccagaactcgcctgcagaggtgccctcctcggacgaggacatcgacacggtgtcggtcgacagactgctcgacatcatcgatgaagagttcgaaaccacatagagaaattgttgctttcgttcgcgacccgatgacgaggacggaccgatgcaggaaccccagcaaggccagccggaccagcaggagaaaatcgtcgactatctccggcgggtcacttcagatcttcgccgtgcccgccgccgcattggcgaactggaatccaaggacaacgagcccatcgccatcgtcggaatgggctgccgacttcccggcggcgtcaattcgccggaatccctgtgggacctggtgcgttccggcggcgacgccatttccggattccccgtcgaccgcggctgggacctggaaaccctcaccggaaacggcgacggcagcagcgccacccacgaaggcggattcctctacgacgccgcggaattcgacgccgccttcttcggcatctcgccgcgcgaggcgactgctatggacccccagcagcgcctcctcctcgaagtcgcctgggaggcgctggagcgcgccggcatcgcccccacagccctgcgcggcagccggtccggcgtgttcgtcggctcctaccactggggcgcgccctcggccgacgccgccaccgaactgcacggccacgccctgaccggcaccgccgccagcgtgctgtccggccgcctggcctacaccctcggcctcgaaggcccggccgtcaccgtcgacaccgcctgctcctcctccctcgtcgccctgcacctggcggcccagtccctgcgcgtcggcgaatcctcgctcgccgtgatcggcggcgtcacgatcctcaccgagccgtccgtcttcgtcgagttcagcgcccagggcggcctggcaccggacggccgctgcaaggcgttctccgacgccgccgacggcaccggttgggccgagggcgtcggtgtcctcgtcgccgagcggctctccgacgcgcagcgcaacggccatccggtcctcgccgtgctgcgcggctccgccgtcaaccaggacggcgcctccaacggcctgaccgcccccaacggcccctcccaggaacgggtcatccagcaggccctcgcccggaccggcctgacccccgccgacatcgacgccgtcgaggcgcacggcaccggcacccggctcggcgaccccatcgaggcccaggccctgctcgccacctacggccagggacacacccccgaccagccgctgtggctcggctccctgaagtccaacatcgggcacacccaggcggccgccggcgtcgccggtgtcatcaagatggtcatggcgctgcgccacggccacctgccgccgaccctgcacgccgacgcgccctcctcgcacgtggactggtccgccggatcggtacgcctgctgaccgagggccagcagtggccggagaccggacgtccgcgccgggccgcggtgtcctcgttcggcatcagcggcaccaacgcgcacgccctgctggaacaggcaccccaccccgcggacaccgcggacgccggcgacgacgccgcgcccaccgaaccggccggcgcgcccgccgcgctgccctggatcgtctccggacactccccgcaggcgctgcgcgaccaggccgccgccctggccgccagggtcgagaccgaccccgcgctccgcccccaggacatcgggcacaccctgcacaccgcccgcgccctgctcgaacgacgcgccgtcgtcgtcgcccccgaccgcgccgaactcctcgcggctacccacgagttggccgccggccggtccgcgaacgccgtcgtcgagggcctcgcggacgtcgagggtcggacggtgttcgtgttccccggtcagggttcgcagtgggtggggatgggggcccaactcctcgatgagtcggcggtgttcgcggagcggattgccgagtgtgcggcggcactcgccgagttcaccgactggtcgctggtcgatgtgctgcggggtgtggtgggtgcgccgtcgttggagcgggtcgatgtggtgcagccggcgtcgttcgcggtgatggtgtcgttggctgcgttgtggggttcccgtggtgtgttgccggatgcggtggtggggcattcgcagggtgagatcgctgccgcggtggtgtcgggtgcgctgtcgttgcgggacggggcgcgggtggtggcgctgcggagtcaggccattggtcgtgcgttggcggggcggggcgggatgatgtccgtcgcgctgtcggtggacgtgctcgaaccgcggttggtcgagttcgaggggcgggtgtcggtggccgccgtcaacggcccgcgctccgtcgtggtcgccggcgagcccgaggcgctggacgcgctgcacgcccggctgaccgccgacgacatccgggcccgccggatcgcggtggactacgcctcgcactcgcaccaggtcgaggacctgcacgaggaactgctggaggtgctggcggagctggcgccgcgcacgtcggaggtgccgttcttctcgaccgtgaccggcgactggctggacaccgcgcggatggacgccggctactggttccgcaacctgcgcggacgggtgcggttcgcggacgcggtggcggacctgctggcggcggagtaccgcgcgttcgtcgaggtcagctcgcacccggtgctgacgatggcggtcttggacctgatcgaggaggccggggtcacggccgtcgcgaccggcaccctgcgccgtgaccagggtggcgcgggccgcttcctgctgtcggccgccgaggtcttcgtgcgcggtgtggacgtggactgggcgggggcgttcgaggggaccggtgcggcccgggtcgacctgcccacctacgccttccagcgcgagcggtactggaacacccgcaccgccgccgaccgcaccccggccgacgccccgatggacgccgaattctgggccgccgtcgaacaggcggacgtctccgcgctgaccgccgcgctcggcaccgacgaggactccgtcgccgccatcctgcccggcctcacctcctggcgccgggcccgctcccagcgcaccaccctcgactcctggcgctaccgcgtcacctggacgcccctcgcccaggtgccccgcgccaccctgaccggcacctggctgctggtcaccaccgacggcatcgacgacaccgatgtggcaggggcgttggagagctacggcgccgaggtgcgccggctggtcctggacgaggagtgcaccgaccgcgccgtcctgcgggagcggctggccggcgcggaggacgtgaccggcatcgtctccgtcctcgccgccgccgaggacgacgccgcacgccaccccggcctcacccggggactcgcgctcaccgtctccctcgtccaggccctgggcgacgccgaggcgaccgcgccgctgtggttcctgacccgcggcgccttcgccaccggcccgtccgaccccgtcacccggcccctgcagagccagatcgcgggcgtcggctggaccaccgcgctggagcacccgcagcgctggggcggcaccgtggacctgcccgacaccctcgacgcccgggccgcccagcggctcgccgccgcgctgtccggcgccctcggcgccgaggaccagctcgccgtccgcgccgccggggtactggcccgccgcatcgtgcgtgccggacaccgcgccggacgaccggcacggacctgggcgccgcgcggcaccaccctgatcaccggcggctccggcaccctcgccccgcagctcgcccgctggctggccgaacgcggcgccgagcacgtggtgctggtcagccggcgcggtgccgacgcccccggagcgcccgaactcatcgcggaggcagccgagtcgggcaccgaggtgaccgtcgccgcctgcgacatcaccgaccgcgacgcggtcgccgcgctgctggccgacctcacggccgacggccgcaccctgcgcaccgtcatccacgccgccgccgccatcgagctgtccgcgctcgccgacaccaccgtggcggagttcgccgacgtcgtgcacgccaaggtcaccggcgcacggatcctcgacgaactgctcgacgacgcggaactggacgacttcgtcctgtactcctccaccgccggcatgtggggcagcggcgtgcacgccgcctacgtcgccggcaacgcctatctgtccgcgctcgccgagcagcgccgcgcccgcggactgcgcaccacctccatccactggggcaagtggcccgacgaccgggcacgcgagctggccgacccgcaccggatccgccgcagcggtctggagtacctcgaccccgagctggcgctcaccgcgctccagcacgtcctggacgacgacgagaccgtcatcggcctcatggacatcgactgggacacctaccacgacgtgttcaccgcgggccggcccgcgcacctcttcgaccagatccccgaggtgcggcgccgcctcgaccaggcatccgtcccggaccccgcgggcccggccgccgacggcctggccgcccgcctgcacggcctcgccgccgccgaacaggaccggctgctgctcaccctggtccgcaccgaggccgccgccgtcctcggccacgcctcggccgagtccttccccgagcgccgcgccttccgtgacctcggcttcgactcggtcaccgccgtggacctgcgcaaccggctcgtggccggcaccggactgcggctgccctcgacgatggtcttcgaccaccccaactgcgcggcgctcgccgcgttcctgaagacgacggcgctcggcgtccccggcgccgcaccgcagcagcacgccgctaccggcaccccggccgacgacgacccgatcgccgtgatcggcatgagctgccgctaccccggcggcgccgccacccccgaggaactgctgcggctcgccctcgacggcgccgacgtcatctcggagttccccgcggaccgcggctgggacgcccggggcctgtacgacccggaccccgaccgccccggccacacctactccgtccagggcggcttcctccacgaggccgccggcttcgatcccggcttcttcgggatctccccgcgcgaggcggtcgccatggacccgcagcagcggctcctgctggagacctcctgggaggcgttcgaacgcgccggtatcgaccccgcgtcactgcgcggcagcgccgccggcaccttcttcggcgccagctaccaggactactcctccaccgtgcagaacggcacgggggagtccgaggcgcacatggtgaccggcaccgcggccagtgtcctgtccggccgggtctcctacctgctcggcctggagggccccgcggtcaccgtggacaccgcctgctcctcctcactggtcgccctgcacctggcctgccagtccctgcgcgacggcgagagctccctcgcgctggccggcggtgcggccgtgatggccaccccgcacgcgttcgtcggcttcagccggcagcgtgccctggccaaggacggccgctgcaagccgttctccgacaccgccgacggcatgacgctcgccgagggcgtcggcgtcgtcctgctggagcgcctgtcccacgcccgcgccaacgggcaccgggtactggccgtgatccgcggttccgccgtcaaccaggacggcgcctccaacggcctgaccgcgcccaacggcccgtcccagcagcgcgtcatccgccaggcgctcgccaacgccggcctgaccggcgccgacgtcgacgcggtcgaggcgcacggcaccggcaccaagctgggcgaccccatcgaggcccaggccctgctcgccacctacggccaggaccgcgacgccgaacggccgctgctgctgggctcggtgaagtccaacatcggccacacccaggccgcggccggcgtcgccggcgtcatcaagatggtgctggccatggacgccggcgaactgcccggcaccctgcacctcgacgcgccctccagccacgtcgactggaccgccggcgccgtggaactgctgcgcgggcgcaccccgtggcccgagagcgggcgcccccgccgggccggtgtctcctcgttcggcatcagcggcaccaacgcccacctgatcctcgaacaggccccggccaccgagccgccagccgaccccgaccgcctccgggacaccgccaccgacaccgtcgtcccctggccgctcgccgccaagtccccggccgccctgcgcgcccaggccgcccggctcctcgccaccgtcgagcacgaccccgacctcccgcccgcccccgtgggccacgccctggccaccacccgcgccgccctcgaacaccgcgccgtcgtcgtcggcgagcgccgcgaggacttcctgcgcggcctggccgccctgtccaccggcgcctcgacggccggcctggtcagcggcatcgccggccccgaccccgagggagcggtcttcgtcttccccggccagggatcccagtggtggggaatgggccgcgaactcctcgccacgtccgaggtgttccgcaccgcgatcgatgactgcgcgacggccctcgccccgtacgtcgactggtcgctgcacgacgtcctggccggcgagggcgaccccgccctgctggagcgggtggacgtggtccagcccgcgctgttcgccatgatggtcgggctgtccgcgctctggcgctcccacggcgtcgtcccggcggccgtggtcggccactcgcagggcgagatcgccgcggcctgcgtcgccggagccctcagcctggccgacgccgcccgcgtggtggcgctgcgcagccaggcactgccgcaactgtccggacgcggcggcatgatgtcggtctccgcccccgtagagcgggtcaccgcactcctcgccccgtggcaggaggcgctgtccgtcgccgcggtcaacggcccctcgtccgtggtcgtctccggcgacaccgacgcgctcgacgccctgcacaccgcctgccaggaacagggcgtgcgggcccgcaaggtgtccgtggactacgcctcgcacgggcggcacgtcgaggccgtccgcgacgaactcgcccgcgtcctcgcgccggtcgacccgcgcgcccccgaggtgccgttctactcgacggtcaccggcgaccgcgtggacgacgccgccttcgacggcgcctactggtacaccaacctccgccagaccgtccgcatggaggaggccacccgcgccctcctcgccgccggacaccgcgtcttcatcgaggtcagcccgcacccggtgctcgccgccccgatccaggagacgcaggaggccgtagcggaggccaccggcgggtccgcggtggtcctcggctcgctccgccgcgacgagggcggcccgcggcgcttcctgacgtcgctcgccgaggcccacacccacggcgccccggtcgactggaccaccaccttcgcccggtccgcctaccagccggtggacctgccgacctaccccttccaacgacaggacttctggcccgaggcccggcccgccaccccggccgccggcgccgacgcgtccgacgccgcgttctggcaactggtcgagaaccaggacctcgccgcgctcgccgacgcgctcggcgtccccgccgacgacgagcacaccgcgctcggcaccgtgctgccggccctgtccgcctggcgcgccaaggcccaggcccgcacccggatcgacgaactccgctaccacgtccagtggacccgggtcgccgagcccgcggcggcccccaccaccggccggctgctggtcgccgtcccgccggaccacgccgacgccccctgggtcgccgcggcgctcgacgccctgggcaccgacaccgtccgcttcgaggccaagggcaccgaccgcgcgggatgggccgcacagatcgcccaactcgtcgaggacggcgaggagttcaccggcgtggtgtcgctgctggccgccgccgaggatctccacccggacttcggctcggtaccgctggggctggggcagaccctcgtcctcgtccaggccctcggcgacgccggcctgaccgcgcccctgtggtgcctgacccgcggcgccgtcgccaccggccgcgacgacgccctcgacagcccgacccagggcgccctgtggggcctcggccgggtcgtggccctggaacaccccgaccgctggggcggcctgatcgacctgcccgccaccctcgacgcccgcgccgcggcccgcctcaccggcctgctcgccgaccccgccggtgaggaccaactcgccgtccgcgccaccggcgtgctcgcccgccgcatggtgcacgccgcgccgtccgcgccccgcaccgggcgccgctggcggggccgcggcacctgcctgatcaccggcggcaccggcggcatcggcggccgggtcgcccgctggatggccgagcacggcgccgcccacctggtcctgaccagccggcgcggcccggacgcacccggcgccgccgcactccgggccgaactggaggccctgggcgcccgcgtcaccctcgccgcctgcgacgtcgccgaccgcgacgccctggccgccctgctggccgacctccccgccgaccagccgctcacctccgtcttccactccgccggcgtggccgacggggacgcccgggcagccgacctgaccctagatcagctcgacgcgctgctgcgcgccaaactgaccgccgcccaccacctgcacgagctgaccgcccccctcgacctcgacgcgttcgtgctcttctcctccggcgccgcggtctggggcagcggcggccagcccggctacgccgccgccaacgcctacctcgacgccctcgccgcccaccgcaggtccctcgacctgcccggcgcgtccgtcgcctggggcacctggggcgaggtcggcatggccaccgtccccgaggtccacgagcgactgcaccgccaaggggtccgcgccatggaaccggaccacgcgatcggcgcgctccagcagatgctggaggacgacgacaccaccctcgccgtgaccctcatggactgggaggcgttcgcaccgagcttcaccgcgacccgacccagcgccctgttcagcacggtgcccgaagccgtccgcgcggtgaccggcgacccgggcaccacggccggcgacgacgtggactccgcgaccccgccgctccgccgccacctggaggagctgtccgccgccgagcgcggccgggccctggtcgaggcggtccgcgccgaggcgtccgcgaccctcggccacgacacccccgacgccatccccgccggccgtgccttccgcgacgtcggcttcgactcggtcaccgccgtcgaactgcgcaaccggctgcgcaccgccctcggcctgccgctgccggccgcgctcgtcttcgaccaccccacccccacggccctcgccggccacctcggcgcgctgctcttcggcaccgcccccgaggacgccggcaccggccgccccgacgaccccgacgcccgcatccgcgaggcgctcgccaccgtccccatcggacggctgcgcaaggcgggcctcctcgacatggtgctgaaactcgccgacggagacgcgaccgacgcccccgcccccgaggccgacgccccctcggaatccctcgacgacatggacgccgaagccctgctgcggctggccaccgagaactcggcgaactgaaagagagctggagcccaccatgagcacgaaccccgacaagtacgtcgaggcactccggtcgtccctgaaggagatcgagcggctgcgccggcagaacgaacagctggtggcggcggcggtcgagcccgtcgcggtcgtcggcatcggctgccgcttccccggcggcgtcacctcccccgaggacctgtgggagctggtcgccgaggggcgcgacgtcatcgggccgttcccgcaggaccgcggctgggacctggagaagttggccggcggcggcgagggcggcagcctcgcgcaggtcggcggcttcgtcgaggacgccgccggcttcgaccccggcttcttcggcatctccccgcgcgaagcggtcgccatggacccgcagcagcgcatcctgctggagatcacctgggaagccctggaacgcgccggcatcgacccgtccaccctgcgcggtacccccaccggcgtcttcgtcggcaccaccggccaggactacggcgaggtcatcaaggcgtccgccgaggacgtcgaggtctactcgaccaccggccacgccgccagcgtcatctccggccggctctcctacaccctcggcgccgagggcccggccgtcaccgtcgacaccggctgctcctcgtccctggtcgccctgcactgggccgtccaggcgctgcgcggcggcgagtgctccatggccctggccggcggcgcgtccatcatggccaccccgggcccgttcgtcgccttcaccgcgcagagcggcctggccgccgacggccgctgcaagcccttctccgaccgggccgacggcaccggctggggcgagggcgccggcatgctggtcctgatgcggctctccgacgcccagcgcgagggccgcccggtcctcgccgtgctgcgcggctccgccatcaaccaggacggcgcctccaacggcctgaccgctcccaacggcccctcccagcagcgcgtcatccgcgccgcgctggacagcgcccacctcaccgccgccgacatcgacgccgtcgaggcccacggcaccggcaccaccctcggcgacccgatcgaggcccaggcgctcctggcgacctacggacaggaccggccgcggcccctgtggctcggctcggtgaagtccaacatcggccacacccaggccgcctccggtgccgccggcgtgatcaaaatgatcatggcgttgcagcgcggcgtgctgccgcgcagcctgcacgccaccgaacccaccacggacgtcgactggaccgccggctccgtcgacctcctcgacgagacggtcgcctggcccgagaccggacgcgcccgccgcgccggcgtctcctccttcggcatcagcggcaccaacgcccacgtcatcctcgaacaggcccccaccgcccccgaagagcccaccaccgaacccaccgtccgccccgccgtcgtcccgtgggcgctctccgcccgcaccgccgccgccctcgacgcccagcgcgcccgcctcaccggccacctcgccgacacccccgacgccgaccccctcgacgtcggctacgcgctcgccgacggacgcgccaccttcgaacaccgcgccgtcctgctccccgacggcaccgaactcgcccacggaaccgccggcgaaggcccctgcgccgtcctcttctccggccagggctcccagcgcccgggcatgggacgcgaactccacgcccgcttcccggtgttcgccgcggccttcgacgagatcacagcgctcctcgacacccacctcgaccgcccgctgcgcgaggtcgtctggggcaccgacgccgacctgctgaacgacaccggctgggcccaacccgccctgttcgccgtcgaggtcgccctctaccgcctggtcgcgtccctcggcgtcacccccgacttcgtcggcggccactccatcggcgagctcgccgccgcgcacgtcgccggggtcctctccctcgaagacgcctgcaccctcgtcgccgcccgcgcccgcctcatgcaggccctgccgcgcggcggcgcgatgctcgcgatccgcgccaccgaggacgaggtcaccccccacctcaccgacgacgtctcgatcgccgccgtcaacgggcccacctccgtcgtcgtcgccggcaccgaggaagccgtcgccgcgatcggggcgcgcttcaccgcccaggaccgcaagaccacccggctgcgggtcagccacgccttccactcgccgctcatggacccgatgctggcggaattccgcgccgtcgccgcgggcctgacctaccacgagccgcgcatcccggtcctctccaacctcaccggcaccgtcgccgccgtcgccgacctgtgctccgccgactactgggtccgccacgtccgcgaggcggtccgcttcgccgacggcgtcaccgccctcaccgaccgcggcgtgaccacgctcgtcgaactcggcccggacggcgtgctgtccgccatggcccaggaatccctgccggacggcgccgccgccgtgccgctgctgcgcaaggaccgccccgaggagctctccgccgtcaccggcctggcccgcgcccacgtccgcggcgtcacggtccgctgggccggcctcttcgacggcaccggcgcgcgccgcgccgacctgcccacctaccccttccagcaccagcggttctggccgaccgcggcccgcgccgcccaggacgtcaccgccgcgggactgggcgccgccgaccacccgctgctcggcgccaccgtcgaactcgccgacggggccggctacttgttcaccagccggctctccgtccggacccacccctggctcgccgaccacggggtccagggccgggccctgctgcccggcaccgccttcgtcgaactggccgtccgcgccggcgacgaggccggctgcgaccgcgtcgaggaactgaccctggccgcccccctggtgctgcccgagcgcggcggcgtccaactccaggtccgcgtcggcgcccccgacgccgccggccgccgcaccctcggcatcttctcccgcgtcgaggacggcttcgacctgccctggtcgcaacacgccaccggcgtcctgaccgccggcgccggcgcccccgaccccaccttcgacgccaccgtctggccccccagcggcgccgaacccgtcgacctcaccggcgcgtacgagcgcctggccgcactcggcttccagtacggccccgccttccagggcctgcgcgccgcctggcgccgcgacaccgaggtctacgccgaagtggccctgcccgacggcgcggacaccgaccccgccgccttcggactgcacccggccctgctggacgccgcacaacacgccgccgcctacgccgacctcggcgccatcagccgcggcggcctgccgttcgcctgggaaggcgtctcgctcgccgccgccggcgccaccaccgtccgcgcccggatcgccccggccggcgaggacaccgtcaccatcgccgtctacgacgccgccggcggcaccgtgctgtccgtcgactccctggtctcccgcgaggtccccgccgacgcacccggcgccgccggcaccgtccaccgcgactccctcttccacgtcgagtggaccccgctccagggccgcccgggccccgcaccggccaccgtcgccgtcctcggccccgacccggacgccctcgccgacaccctccgcgccaccggcatccggaccaccgccccccgcgacctggccgccctcgccgacgccgaagggcccgtccccgacctggtcgtcaccaccctcaccaccaccccgggcgcccccgtccccgacgccgcgcacgccaccaccgccgccgtcctcgccctcgcccaacagtggctcgccgacgaccgcttcgccgacgcccgcctggtcctcgtcacccgcggcgccaccgacggcaccgaccccgccgccgcggccgccggcggcctgatccgcaccgcccgcaccgagaaccccggccgtttcgccctcctcgacctcgcccccgacaccggccggcccgaccccgagaccctggccaccgccctggccgccagccacgacgagcccgacctcgccgtccgcggcaccgacgtgcacgccgcccgcctggcccgtgtcccgctcgccaccgaacccaccacctggaacccggacggcaccgtcctgatcaccggcggcaccggcggcctgggcgcggtcctcgcccgccacctggtcgccacccacggcgtccgccacctgctgctcgccagccgccgcggcccggccgccgacggcgccgacgacctgacggccgaactcaccgggctcggcgccaccgtccacatcgccgcctgcgacgtcgccgacccggccgccctcgccgacctgctcggcaccgtcccggccgggcacccgctcaccgtcgtcgtccacaccgccggcgtcgtcgacgacggcgtcctcggctccctcaccccgcagcgcctggacaccgtcctgcggcccaaggccgacgccgcctggcacctgcacgaggcgacccgccacctcgacctggacgccttcgtcctcttctcgtccgtcgccgccaccctcggcagccccggacaggccaactacgccgccggcaacgccttcctggacgccctcgccgcccggcgcgccgccaccggcctgcccgccacctccctcgcctggggcccgtggacccagagcgtcggcatgacaagcagcctgtccgacctcgacgtcgagcgcatcgcccgctccggcatgcccccgctgaccctggaacagggcaccgccctcttcgacgcggccctggccgccgggcccgccgccctcgccccggtccgcctcgacctgcccgtcctgcgcacccagggcgacatcgccccgctgctgcgcggcctgatccgcacccccgtgcggcgcaccgccgcccaggtctcgcagaccgccgacggcctcgcccagcggctcgccggcctcgacgccgccgcccgccgggaagccctcctggaactcgtccgcacccagatcgcccaggtcctcggccacgcggacgccaccgaggtggagaccggccgccagttccaggacctcggcttcgactccctcaccgccgtcgaactccgcaacgccctgaacaccgccaccggcctgcggctgcccgccaccatggtgttcgactacccgacaccacacgccctcgccgaccacctgcgcgacgaactcctgggcaccgaggccgagtcgaccaccgccgtccccgtgccgacccgtaccgccggcaccgacgacccgatcgtcatcgtcggcatggcctgccgctaccccggcggcatcgcctcacccgaggacctctggcgcctggtcagccagggcgccgacgccactggcccgttccccaccaaccgcggctgggacctggacaacctctacgaccccgaccccgaccgcccgggccgcacccacgtccgcgccggcggcttcctgcacgacgccggctccttcgacgccgacttcttcgggatgagcccgcgcgaggcgatggccaccgactcccagcagcgcctgctgctcgaactctcctgggaagccgtcgaacgcgccggcatcgaccccgcctcactgcgcgactccggcaccggcgtcttcgccggcgtcatgtacaacgactacggcaccaccctgaccggcgacgagtacgaggcgttccgcggcaacggcagcgccccgagcgtcgcctccggccgcgtctcctacaccctcggcctggaaggcccggccgtcacggtggacaccgcctgctcttcctctctggtcgccctgcactgggcggcgcaggcgttgcgggcgggggagtgctcgttggcgttggccggtggtgtgacggtgatgtcgacgccgagcacgttcgtggagttctcgcggcagcggggtctggcgcctgatggtcgttcgaaggcgttcgccgaggccgcggacggcgtggcctggtccgagggcgtcggcatgctggtcctggagcggcagtcggacgcggtgcgcaacggtcacgagatcctggccgtggtgcgcggctcggcggtcaaccaggacggtgcgtccaacggtctgaccgcgcccaacggcccgtcccagcagcgggtgatccgtcaggcgttggccagtggcggcctgtccacggccgacgtggacgccgttgaggcgcacggcacgggtacgacgctcggtgacccgatcgaggcccaggcgctcctggccacctacggtcgcgaccgcgaccccgagaacccgctgctgctcggctcgatcaagtccaacatcggtcacacccaggcagcggccggtgtcgccggtgtcatcaagatggtcatggcgatgcggcacggcgtgctgccgcagaccctgcatgtcgacgcgccgtcctcgcacgtcgattggagcgtcggcgccgtcgaactgctcaccgagcagaccgcctggccggagaccggccgggcccgtcgcgccggtgtctcctccttcggcatcagcggcaccaacgcccacgtcgtcatcgagcagtccccgaccgccgtccccgccacgcccgcgtccgccgaccggtccgtcgaggaaccgccggccgtcccctgggccctgtccggcaagacccccgacgccctccgcgaccaggccgcccgcctcctcgcccacgtcgaggcccaccccgcactgcgccccgtcgacatcagctactccctgatcgccacccgcaccgccttcgaccaccgcgccgtcgtcctcggcaccgaccgcgccgaggccctgcgcgccctcaccgccctcgccgccggcgagaccgacccggccgccctcaccggcaccgtccgcaccggccgcaccgccttcctcttctccggccagggctcccaacggctcggcatgggccgcgtcctctacgagcggttccccgccttcgccgaagccctcgacaccgtcctcaccgccctcgacgcggaactcggccaccccctccgcgacatcatctggggcgaggacgctcaactcgtcgaccggaccggctacacccaacccgccctgttcgccatcgaggtggcactcttccgcctcctggaagcctggggcatcacaccggacttcgtggccggccactccatcggcgagatcgccgccgcacacgtcgccggcgtgctctccctcggcgacgcctgccgcctcgtcgtggcccgcgccgtgctgatgcagtcgctgcccgaaggcggcgcgatgatcgccgtccaggccaccgaggacgaggtcctgcccctcctcaccgacgacgtctcgatcgccgccgtcaacagcccgacctccgtcgtcgtctccggctacgagaacgccaccctcgccgtcgcccggcacttcgccgaccagggccgccgcaccacgcggctgcgcgtcagccacgccttccactcgccgctgatggcgccgatgctcgacgacttccgcgccgtcgtcgagagcctcaccttcaccgcccccacgacccccgtcgtctccaacctgaccggcgaactggccccggccgaggcgctctgctcggccgactactgggtccggcacgtccgcgaggcggtccgcttcgccgacggcatccgcaccctcgccgaccgcggcgtcaccaccttcgtcgaactcggccccgacagcgtgctgtccgccatggcccaggagtccgcccccgaaggcgccggcaccatcccgctcctgcgccgcgaccggcccgaggaacaggccgtcctggccgccctctgccacctccaggtgctcggcgtcgaggccgactggtccgccaccttccgcggcctcgaccccgtccgcgtcgacctgccgacctacgccttccagcaccgctggttctggcccgccgcccgacccgcccgccccgacgacgtccgcgccgccggcctgggcgccgccgaacaccccctcctcggcgccgccgtgcaactccccgacgacgacggcgcactcttcaccggccgcctctccctgcgcacccacccgtggctggccgaccacaccgtcctgggcaccgtcctgctcccgggcaccgcactggtggaactcgccgtccgcgcgggcgacgagaccggcagcggccacctcgaagaactcaccctcgccgcgcccctgaccctccccgaggacggcgccaccctcctccaggtccgcgtcggatccgccgacgacaccggccgccgcaccgtcaccgtccacgcccgccccgacgacaccgccgaccgcacctggacgctgcacgccaccggtgtgctcgccaccacgccaccggccgccgcggcgttcgacaccacggtctggccgcccgccgacgccgaacccctcaccaccgacgactgctacgcacacttcaccacccaccgcttcgcctacggccccgccttccagggcctgcgggccgcctggcgcgccggcgacgtgctgtacgccgaggtcgccctgccggagtccgccaccgacgaagcggccgccttcggcctgcacccggcgctcctggacgccggcctgcacgccgcgctcctcgccgacgaccgcgacaccggactcccgttctcctgggaaggcgtcactctgcacgcctccggcgccaccgcgctacgcgtccggctcgccccgaacggccccaacggcctgtccgtcaccgccgccgacccggccggcaaccccgtcgccaccgtcacccgcctgctcgcccgccccctggacgccgagcagttgaccatccacagcgccctgacccgcgacgcgctcttccacctggactggaccccggtcccgcttcccgacaccgccaactccgcgccgccggccctcctcggcccggacaccgccgtgctcgccgacgccctcggcgacccggccgtcgcacgccacgcaaccctcgacgacctcctggccggggacaccaccccgcccgccacggtcctcgtccccctcggcgccccactcgacggcgacaccgcgcagcacgcgcacgccctcacccgcagcgcgctgaccctcgtccagcagtggctcgccaccgaccgcctcgccgactcccgcctggtcttcgtcacccacggagccgtcgccaccgacgacgcgccccccaccgacctggccgccgccgcggtctggggcctgatccgctccgcgcagaccgagaaccccggcaccttcaccctcctcgacctcgacaccgagcccgactcgaccaccgcgctcagccgcgccctgaccctcgacgaaccacagctcctcctccgcgccggccgcgcccgcgccgcccgcctcacccgcacccccgcccccaccaccaccacccacacgccgtggtccgcggacggaacggtgttggtgacgggtggtacgggtggtctgggtgggttggtggcccggcatctggtgcggtcgtgtggggtgcggcatttgttgttgaccagtcgttctggtgtgggtgctgcgggtgcggccgggttggtcgcggagttggagtcgttgggcgcgcgggttgtggttgcggcgtgtgatgtgggtgatggctcggctgttgcggagttggttgccggtgtgtcggagtcgtatccgttgtctgcggtggtgcatgcggctggtgtgttggatgacggtgtggtgggttcgttgacgccggagcggttggctgcggtgttgcgtccgaaggtggatggtgcgtggaacctgcatgaggcgacgcgtggtctggatctggacgcgtttgttgtcttctcgtctgttgcgggtgtgttcgggggtgcgggtcaggccaactatgcggcgggtaatgcgtttttggacgcgttgatggttcatcgggtggctggtgggttgcctggtgtgtcgttggcgtggggtgcttgggatcagggtgtggggatgacggcggggctgacggagcgggatgtccgtcgtgctgctgagtcgggtatgccgttgttgacggttgatcagggtgtggcgttgttcgatgcggcgttggcgacggggagtgccgcgttggtgccggtccgtctggacctggccgcactgcgcacccggggcgacatcgcaccgctcctccgcggcctcgtccgcgcaccgctgcgccgcaccgcggccaccggcctcgccaccggcgcggacaccggcctcgtccaacggctcggccgactcgaccacgcccaacgccacgaggcactgctcgacatggtccgcagcagcgccgcgctcgtcctcggccacgccgacggcaacgccatcgacgccgaacgcgccttccgcgacctcggcttcgactcgctcaccgcggtcgaactccgcaaccgtctgcgcaccgccaccggcctgcacctgtcggccaccatggtcttcgaccaccccaccctgtccgccctcgcggagcacctgcgggacgagttgttcggcgcggtcgagagcgaggtgcgggtgccggtccaggcactgccgccgaccgccgacgatcccatcgtggtggtgggcatggcctgccgtttccccggtggtgtgacctcgcccgaggacctgtggcgcctggtcgacgacggcaccgacgccatcaccaccttcccgaccaaccgcggctgggacctggacaacctctacgacccggaccccgagcacttcggcacgtcgtacacccgctccggtggcttcctgcacgaggcgggggagttcgacccggcgttcttcggaatgagcccgcgtgaggcgctggcaaccgactcccaacagcgtctcctgctggaatcctcctgggaggcgatcgagcgggccggcatcgacccgctgaccctgcgcggcagcgccaccggcgtcttcgccggcgtgatgtacagcgactacgggagcatcctcggcggcaaggagttcgagggcttccaaggccagggaagtgcgggcagcgtggcctcgggccgcgtctcctacgccctcggcttcgagggcccggccgtcacggtggacacggcttgctcttcctctctggtcgccctgcactgggcggcgcaggcgttgcgggcgggggagtgctcgttggcgttggccggtggtgtgacggtgatgtcgacgccgagcacgttcgtggagttctcgcggcagcggggtctggcgcctgatggtcgttccaaggcgttcgccgaggccgcggacggcgtcggctggtccgagggcgtcggcatcctcgtcctggagcgccagtcggacgcggtgcgcaacggccacgagatcctcgccgtgatccgcggctcggcggtcaaccaggacggtgcgtccaacggcctgaccgcgcccaacggcccgtcccagcagcgcgtcatccgtcaggcgttggccagtggcggcctgtccacggccgacgtggacgccgtcgaggcgcacggcacgggtacgacgctcggtgacccgatcgaggcccaggcgctcctggccacctacggccgtgaccgcgaccccgagaaccccctgtggctgggctccctgaagtccaacatcgggcacacccaggcagcggccggtgtcgccggtgtcatcaagatggtcatggcgatgcggcacggcgtgctgccgcagaccctgcatgtcgacgcgccgtcctcgcacgtcgattggagcgtcggcgccgtcgaactgctcaccgagcagaccgcctggccggagaccggccgggtccgtcgcgccggtgtctcctccttcggcatcagcggcaccaacgcccacgtcatcgtggaacagccggcgctcgtcgaaagcccggccgcggagccgagcggacgcgaacccggcgtcgttccgctgccgctgtccggaaagtcccccgaggccctgcgcgaccaggccgcacgcctgctggccgggttggcggagcggcccgcgctgcgcccgctcgacctcggctactcgctggcgacgacccgttcggcgttcgaccaccgggcggtggtgctcgccaccgaccgcgccgatgcggtccgcgcgctgacggcgctcgccgccgccgacgcggatctctccgccgtcgtcggcgacacccgcacgggtcgtcacgcggtgctgttctcgggtcagggctcgcaacgcctgggcatggggcgtgagttgtacgagcgtttcccggtcttcgccgaggctctcgatgtcgcgatcgaccacctggacgccgccttgcccgcccaggccagtctgcgtgaggtgatgtggggcgacgatgtcgagctgctggacgagacgggttggacgcagccggctctgttcgccgtcgaggtggccctgttccggctggtggagagttggggtgtccgtccggacttcgtggccggtcattccatcggtgagatcgcggcggcgcatgtcgtcggggtgttctcgctggaggacgcctgccgtctggtggccgcccgtgcgacgctgatgcaggcgctgccgaccggcggcgcgatgatcgcgatccaggccgccgaggacgaagtcacccagcacctgactgacgacgtctcgatcgccgccgtcaacggcccgacctccgtggtcgtctccggggccgagagcgctgcccgcacggtggccgaccggctcgcggagaacggccgcaagacgacccggctgcgggtctcgcatgcgttccactcgccgttgatggatccgatgctggcggagttccgtgcggtggccgagggcctgtcctacgccaccccgaccctccccgtcgtctcgaacctgacgggccggctggccacggccgatgacctctgctcggccgagtactgggcgcgccacgtccgcgaggcggtccgcttcgccgacggcgtcagcaccctggagaacgagggcgtcaccacgttcctggaactgggaccggacggcgtgctgtccgccatggcccagcagtcgctcaccggcgacgccgccaccgtcccggccctccgcaaggaccgcgacgaggagacgtccgcgctcaccgccctcgcccacctccacacggcaggtctccgcgtcgactgggcggcgttcttcgccggcagcggcgccacccgcgtggacctgccgacctacgccttccagcacgccacctactggcccaccggcaccctgcccaccgcgcacgccgcggccgtcggcctcaccgccgccgagcacccgctgctgaacggttcggtcgaactcgccgaaggcgaaggggtgttgttcaccggacggctgtcactgcagtcacatccgtggctggccgaccacgccgtcatgggacaggtcctgctgcccggcaccgcactgctggaactggcgttccgggccggcgacgaggccggttgcgaccgcgtcgaggaactgacgctcgccgcaccgctcgtcctgcccgagcgcggtgcggtacagacccaggtccgggtcggcgtcgccgacgacaccggccgccgtaccgtcaccgtccactcccggcccgagcacgcgaccgacgtgtcgtggacccagcacgcgaccggcaccctgaccatgggctccgccccggccgacaccggtttcgacgccactgcctggccgcccgccgacgccgaacccctcgccaccgacgactgctacgcgcgcttcacgacgctcggcttcgcctacgggccggtcttccagggcctgcgggccgcctggcgcgccggtgacgtgctgtacgccgaggtggccctggcggagtccaccggcgacgaggcgaccgccttcggtctgcaccccgcactgctcgacgccgccctgcacgcctccctcgtcgcccacgagggcgaggagagcaacggcggactgccgttctcctgggagggcgcgaccctctacgcgaccggcgccaccgcgctgcgcgtccggctgaccccgacgggcaccgacggccgttcggtggccatcgccgtggccgacaccgccggtcgtccggtcgccgccatcgacaacctcgtctcgcgccgggtctccggcgaccagttgaccggcgccgcgggactggcccgcgacgccctgttcaccctggactggaaccccgtaccggagaacctcgtaccggagaaccctgtaccggagaacaccggcgggggccacgcccaggaccaggacggccggcccgccgcggccaccgtcgcgctggtcggcgcggacggcaccgcgatcgccgccgacctgaccgccgccggcatccacaccaccctccaccccgacctcaccaccctcgccacgaccgacgccgacgttccgaagacggtcctcatccccctcaccggaaccggaaccggaaccggcaccgggactgagtcgacggacggaatcgggacgggggccgccgagtcggacgcgtccgccccctccccggccgaggtcgcccacaccctgtccaccgccgcactcgccctcgtccaggagtggaccgcacaggagcgcttcgccggctcccgcctggcgttcgtcacgaccggggcgacggccgccggcggtaccgacgtcatggacgtggccgccgccgcggtctggggcctggtccgatccgcccagtccgaagccccggacaccttcgtcctgatcgaccgtgaccccggcccggccggcacgcacgaccgcacagccgccgccgaacggggccaactgctcctacgggcactgcacaccgacgaaccgcagctcgccctgcgtgacggcggcgtgctcgccgcccgcctggcccgcttcgacaccgcggccgcgctcaccccgccggccgaccgggcctggcggctcgacagcacggccaagggcagcctcaacggcctcgccctgaccccgtatccggcggcactggcgccgctcaccggccacgaggtgcgggtcgaggtgcgtgccgcgggcctgaacttccgtgacgtgctcaacgcgttggggatgtatccgggtgatgatgtcggatcgttcggttcggaggcggccggtgtggtcgtcgaggtcggaccggaggtgaccggcctggcccccggcgaccaggtcatgggcatgatcaccggcagcttcggctcgctcgccgtggacgacgcgcggcgcctcgcccgcctgcccgaggactggtcctgggagacgggtgcgtcggtgccgttggtgttcctcaccgcgtactacgccctgaaggagttgggtggtctgcgggcgggggagaaggtgctggtgcatgccggtgccggtggtgtcggtatggcggcgatccagatcgcccggcatgtcggtgccgaggtgttcgccacggccagtgagggcaagtgggacgtgttgcgctcgctcggcgtggccgacgaccacatcgcctcctcccgcaccctcgacttcgaggcggccttcgccgaagtcgccggcgaccgcggcctggacgtcgtcctcaactccctcgccggtgacttcgtcgacgcctcgatgcggttgctcggcgacggcggccggttcctggagatgggcaagaccgacatccgcgccgcggactccgttcccgacggcctctcctaccagtccttcgacctcgcctgggtggtgccggaaaccatcggcaccatgctggccgagctgatggacctcttccgcaccggcgcactgcggccactcccggtccgcacctgggacgtccggcacgccaaggacgcgttccgcttcatgagcatggccaagcacatcggcaagatcgtgctcaccctgccccgctcctggaagcccgagggaacggtgttggtgacgggtggtacgggtggtctgggtgggttggtggcccggcatctggtgcggtcgtgtggggtgcggcatttgttgttgaccagtcgttctggtgtgggtgctgcgggtgcggccgggttggtcgcggagttggagtcgttgggcgcgcgggttgtggttgcggcgtgtgatgtgggtgatggctcggctgttgcggagttggttgccggtgtgtcggagtcgtatccgttgtctgcggtggtgcatgcggctggtgtgttggatgacggtgtggtgggttcgttgacgccggagcggttggctgcggtgttgcgtccgaaggtggatggtgcgtggaacctgcatgaggcgacgcgtggtctggatctggacgcgtttgttgtcttctcgtctgttgcgggtgtgttcgggggtgcgggtcaggccaactatgcggcgggtaatgcgtttttggacgcgttgatggttcatcgggtggctggtgggttgcctggtgtgtcgttggcgtggggtgcttgggatcagggtgtggggatgacggcggggctgacggagcgggatgtccgtcgtgctgctgagtcgggtatgccgttgttgacggttgatcagggtgtggcgttgttcgatgcggcgttggcgacggggagtgccgcgttggtgccggtccgtctggacctggccgcactgcgcacccggggcgacatcgcaccgctcctccgcggcctggtcaaggcgcccatccgccgcgcagccgccaccacacccggcgacaccggactcgccgagcagctcacccggctccagcgcgccgagcgacgggacaccctcctcgcgctcgtccgcgaccaggccgcgatggtcctcggccacacctcgggcgacggcgtcgacccgtcccgcgccttccgcgacctcggcttcgactcgctcaccgcggtcgaactccgcaaccgcatcggcgcggccaccggcctgcggctaccggccacggccgtcttcgactaccccaccgccgatgccctcgccgcacacctgctcaccgaactgctcggccccgacgccgagtcggaccccgacgagcccggcgaccccaccgcgggaccgaccgacgaccccatcgtcatcatcggcatgagctgccgcttccccggcgacatcggctcgccggaggacctgtggcgcctgctcggcgacggcgccgacgtcgtcaccgacttcccgaccaaccgcggctgggacctggacaacctctacgaccccgaccccgcgcacgccggcacctcgtacgcccgcaccggcggtttcctgcacgacgccgccgacttcgacgccgacttcttcggcatgagcccccgcgaggccatggccacggactcccagcagcgcctgctgttggagtcctcgtgggaggcgatcgagcgggccggcatcgacccgctgaccctgcgcgacagccgcaccggcgtcttcgccggcgtcatgtacagcggctacggcacccgcctcgacggcgccgaattcgaaggcttccaggggcagggcagcgcactgagcgtggcctccggccgggtctcctacaccttcggcttcgaaggcccggccatgacggtcgacaccgcctgctcctcctcgctggtcgccctgcacctcgccgcacaggcactccgcggcggtgagtgcaccctcgccctcgccggtggtgtcaccgtgatgtccatcccggacaccttcatcgagttctcccggcagcgcggactggcccccgacggccgctccaagccgttctccgagtccgccgacggcgtcggctggtccgagggcgtcggaatgctgctcctggagcgccagtcggacgccgtgcgcaacggccaccagatcctggccgtggtgcgcggctcggcggtcaaccaggacggtgcgtccaacggcctgaccgcgcccaacggcccgtcccagcagcgggtgatccgtcaggcgttggccagcggcggcctgtccacggccgacgtggacgccgtcgaggcgcacggcacgggcaccacgctcggtgacccgatcgaggcccaggccctcctggccacctacggccgcgaccgcgaccccgagaacccgctgctgctcggttcgatcaagtccaacctcggccacacccaggcagccgccggtgtcgccggcgtcatcaagatggtcatggcgatgcggcacggcgtgctgccccgcagcctgaacatcaccgagccgtcctcgcacgtcgattggagcgccggcgccgtcgaactgctcaccgagcagaccgcctggccggagaccggccgggcccgtcgcgccggtatctcctccttcggcatcagcggcaccaacgcccacgtcatcctggagcagccggaggccgcgcggcactcggcgccggaagaagccgacacggcggaggcagccgccaaggcgccggccaccgcgcacctgcccgtaatgccgtgggcactgtccggcaagacgccggaggccctgcgtgcccaggccgcacgcctcctcgcccacctccagcagcgccccgaactcgcacccgccgacatcgccctgtccctcgccacccagcgctcccagttcacccaccgggcagtcgtcctgagcaccgaccgtgacgaggcgacccgcgcgctgtccgccctcgccaccaccgccgcgtccgacccctcggccctcaccggcacggtcaccatgggacgttgcgcggtgctgttctcgggtcagggctcgcaacgtctgggcatggggcgtgagttgtacgagcgtttcccggtcttcgccgaggctctcgatgtcgtgatcgatcacctggacgccgccttgcccgcccaggccggtttgcgtgaggtgatgtggggcgacgatgtcgagttgctgaacgagacgggttggacccagcccgcgctcttcgccatcgaggtggcgctgtttcggctggtggagagttggggtgtccgtccggacttcgtggccggtcattccatcggtgagatcgcggcggcgcatgtcgtcggggtgttctcgttggaggacgcgtgccgtctggtggccgcgcgggcgacgctgatgcaggcgttgccggccggtggcgcgatgatcgcggtccaggcgaccgaggacgaagtcatcccgcacctgaccgacgaggtggcgatcgcggccgtcaacggcccgacctccgtggtgatctcgggcgcagaagaggccacgcagaccgtggcacaacacttcgccgaccaggggcgccggacgaccgcgctgcgggtctcgcatgcgttccactcgccgctgatgatgctggcggagttccgtgcggtggccgagggcctgtcctacgccaccccgaccctccccgtcgtctcgaatctgacgggccaggtggccacggccgacgaactctgctcggccgagtactgggtgcgccacgtccgtgaggcggtccgcttcgccgacggtgtgacggccctcgaagccgagggcgtgcggaccttcctggaactcggcccggacggcgtcctcgccgccatggccagggaaaccgtcgccgacgacacggtcaccgtccccgtcctccgcaggaacatgcccgaggaacggaccctgctcaccgcactcggccggctccacaccaccggaaccccgatcgactgggccgccctcctggccccgaccggcgcccgcccggtggacctgccgacatacgcgttccaacaccgtcccttctggccctccggcccccgcgacaccgcggatgccgccgccgtcggcatcgccggcgcgagccacccgctcctcaacggcatcgtcgaactcgccgacgaagagggcctgttgttcaccggacggctgtcactgcagtcgcatccgtggctggccgaccacgccgtcatgggacaggtcctgctgcccggcaccgcactgctggaactcgccctgcgcgccggcgacgaggtcggctgtgaccacgtcgaggaactgacgctcgccgcaccgctcgtcctgcccgagcgcggcgcggtacagacccaggtccgggtcggcgtcgccgacaccaccgggcgccgcaccgtcacgatccactcgcgtcccgcacgcgccacgaccaccgacagtgacacccacaccggcaccgacaccccgtggacccaacacgccaccggcgtcctcgtcgccggcctgccggcgacggcaaccgtcccgttcgatgccaccgtgtggccgccggcgcacgccgaacccgttgacctggcggacttctacgcgtcccgggccggcgaaggattcggctacgggcccgctttccagggcctgcgagcggcctggcgccgcgacggcgaggtgttcgccgatgtcgcactgccggaggccggccgtaccgaagccgaggcgtacgggctgcatccggcactgctcgacgccggactgcacgcagcctggctcgtcgccccggacggggagcccacacggacgggcagcgtgccgttctcgtggcgcggcgtcttcctggccgcttccggtgcctcctcggtccgcgtccgactcggccgcgactccgacggaacgctgagcctggccatcgccgacaccaccggtgcaccggtcgcgtccgtacaggccctctccatgcgcaccgtctcggtgacggccctgagcgccaccgcgggcctcgcccgcgacgcgctgttccgcctggactgggcctcggccccggagccggcgtgccagccggacgacacggtgaccgtgatcccggcggtcgcggtcgtcggtacggaaacctccgaactcacctccgagctcaccgcggccctgcgtgcggcgggcgccgacgtcgacgtccgcacgaccctgtcgaccgatgaacccgcgcccgcgctgatcgcgctgccgctcgtcgcctccgaccagaccggcaccgcagaagcggcacccgtcccggcggccgtgcacgacctcacccgccgagccctggccctcgtacagacccgcctgcaagagcagcacttcgcggacacgaagttcgtcttcgtgacccgtggtgcgacggtcgggcgtgatgtggctgctgctgcggtgtggggtctggtgcgttcggcgcagtcggagaatccgggttgttttgctctggtcgatctggatccggatggtgcggtgggtgcggctgcgctcgtcgctgcgttggtcagtggtgagccgcagcttgcggtgcgcggtgatgtgttgcgggtcgcgcgtctggtgcggcggccgctcaccgaggtcggtgcgggtgctgatggcaccggggatggcgtcgggggtggctctggtgtgtcgttctcgggtgagggtgcggtcctggtcactggtggtacgggtggtctgggtgcggtgttggcgcgtcatctggtggccgagtatggggtgcgggatctgctgttggtcagtcgcagtggtgaacgtgccgtgggtgctggggagttggtggcggagcttgcgggtgtgggtgcgcgggtgcgggtggttgcgtgtgatgtgaccgatcgtgccgcggtggtggagttggttggcgggcatgcggtgtccgcggtggttcatgcggctggtgtgctggatgacggcatggtgggtgcgttgaccggggagcggttgtccgcggtgctgcggccgaaggtggatgctgtctggcatctgcatgaggcgacccgcggcctggatctggacgcgttcgtcgtcttctcctctctcgccggggtcttcggcagtcccggccaggccaactacgcggccgcgaacgccttcctggacgcgctgatgacgcggcgccgggcggagggactgcccggcctgtcactcgcatggggaccgtggtcgctgaccgatggcacatcgggcatgctcgcggacgccgaggccgatcgcctgacccgttcgggagtgccaccgctgaccgcggagcaaggactggcactgttcgacgcggccctggcgaccggtgacgccacctgcgtcccggtccgcctggacctgtcggcactgcgtgcccagggtgaggtgccgcccttgctgcggtccctgatccgaggccgctcgcgccgcgccgccgccgcggaatcggcaaccgccaccgggctgcgggaacggctcgtcggactgaacccggtcgagcgacaggaagtcctcctggacctcgtgcgcggccaggtggccctggtcctcggccacgccgacgccgacgacgttcatccggcacgtgccttcagggagttgggcttcgactccctcacctcggtggaactgcgcaaccgcctcaacaccgtcaccggtctgcggctccccgcgaccatggtgttcgactatccgaccgtcgaagtgctggtctcctacgtcctggacgagttgctgggcacggatgccgaggtggcgaccgtgcagccggccgcggttgcggtggcggacgatccgatcgtcatcgtgggcatggcctgccgctaccccggcggggtcgcctctccggacgacctgtggaggctcgtcacggacggcgtcgacgcggtgtcccccttcccgaccaaccgtggttgggacgtcgaatccctctatcacccggaccccgaccatctcggtacctcctacacgcgctcgggtgggttcctgcatgaggcgggggagttcgatccggggttcttcgggatgagtccgcgggaggcgttggcgaccgattcccagcagcggttgttgttggagtcgtcgtgggaggcgatcgagcgggccggtattgatccggtgagtttgcggggtagtcggacgggtgtgttcgcgggggtgatgtacagcgattacagcgcgatgttggcgagtccggagttcgagggtttccagggcagtgggagttcgccgagtttggcgtcgggtcgggtggcctacacgttggggttggaaggcccggcggtgacggtggatacggcgtgttcgtcgtcgttggtggcgatgcactgggcgatgcaggcgttgcgtagtggtgagtgtgggttggcgttggccggtggtgtgacggtgatgtcgacgcctgcggtgtttgtggactttgctcggcagcggggtttgtcgccggatggtcggtgcaaggcgtttgcggatgcggccgatggtgtgggctggtccgagggcgtcggcgtgttggtcctggagcggcagtcggacgcggtgcgcaatggtcacgagattttggctgtggtgcggggttcggcggtcaaccaggatggtgcgtccaatggtttgacggcgcccaatggtccgtcgcagcagcgggtgatccggcaggcgttggccagtggtggtctgacggccggtgacgtggatgtggtggaggcgcatggtacgggtacgacgctcggtgatccgatcgaggcgcaggcgttgttggcgacgtatgggcgggatcgtgagcctgagcggccgttgttgttgggttcggtgaagtcgaatctggggcatacgcaggctgctgcgggtgtggcgggcgttatcaagatggtgttggcgatgcggcatggtgtggtgccgcggacgttgcatgtggatgcgccttcttcgcatgtggactggtccgagggtgcggtggagctgctcagtgagcaggcggcttggccggagacgggtcgggtgcggcgggcgggtgtctcctccttcggcatcagcggcaccaacgcgcacgtgattctggagcgtccggaggccgcgcggcgtccggtgatggagacgaacaccgtggagccgtccacggtgccgtgggtgctttccggcaagacaccggaggccctgcgcgcccaggcggcgaaactgttgtcgtcgatcgaggaacgcccggagcttcgcctcgtcgacgtgggaatgtccctggtcaccggccgctcgacctttgaacaccgtgcggtggtactcgccgccgaccgtgccgacgccgcccgcgcattgtcggcgattgctgccgacgaggccgatgctgccgctgccaccggccgcgtcggcgcgggtcgtcacgcggtgctgttctcgggtcagggtgctcaacgtctgggcatggggcgtgagttgtacgagcgtttcccggtcttcgccgaggctctcgatgtcgtggtcgaccacctggacgccgccttgcccgcccaggccggtttgcgtgaggtgatgtggggcgacgatgcggagttgctgaacgagacgggttggacgcagccggctctgttcgccatcgaggtggcgctgttccggctggtggagagttggggtgtccgtccggacttcgtggccggtcattccatcggtgagatcgcggcggcgcatgtcgccggggtgttctcgctggaggacgcctgccgcctggtggccgcccgtgcgacgctgatgcaggcgttgccggccggcggtgcgatgatcgcggtccaggcgaccgaggacgaagtcaccccgcatctgaccgacgacgtagcgatcgccgccatcaacgggccgaacgcactggtcgtatcgggtgtggaggatgccgccgtcgagatcggggcgcggttcgcggccgaggggcgtcgcacgacccgactccatgtgtcgcatgcgttccactcgccgttgatggatccgatgctggcggagttccgtgtggtggcggagggcctgtcctatgctgctccgtccctccccgtcgtctcgaatctgacgggccaggtggccacggccgacgaactgtgctcggccgagtactgggtgcgccacgtccgcgaggcggtccgcttcgccgacggggtgacggccctcgaagccgagggcgtgcggaccttcctggaactcggcccggacggcgtcctcgccgccatggcaggagcctcgctcaccgaatcctccctcgcggtaccgctgctccgtaaggaccggccggaggaaccggcggcactcgccgccctggcccagttgcacatcgccggcgcgcgcgtcgattggcccgtgctcttcgctggtgtgggtgcggggcgggtggagttgccgacgtatgcgttccagcgtgggtggttctggccggttggtcgggttggtgttggtggtgatgtgggtgctgtggggcttgggtctgcggggcatccgttgttgggtgctgcggtggagttggctgcgggtgcgggggtggtgttgacgggtcgtctgtcgttgtcgtcgcatggttggttggctgatcatgcggtgatggggcgggtgtttgttcctggtacggcgttgctggagatggtgatgcgtgctggtgatgaggtggggtgtggtcgtgttgaggagctgacgttggcggcgccgttggtgttgcctgagcgtggtggggtgcgggttcaggttgctgtggatgctcctgatgctgcgggtcgtcgtggtgtgggggtgtattcgtgtcctgatggtgtgggtcaggcggtgtggtcgcagcatgctgtcggtgtgttggcctctggtgtggctgaccaggtcggtgggttcggtgacggtggtgtgtggccgccgcagggtgcggtgtcggtggatgctgagggctgctacgagctgtttgcggatgctgggttcggttatggcccggtgttccaggggttgcgtgcggtgtggcgtcgcggcgaggaactcttcgcagaggtcgccctgtcggacgaggttgctgagagcgctgatacggcgaccggtttcgggttgcacccggcgttgctggatgcctcgctccatgcctcgcttctctcctcccttgaaggtcaatccgccgatggtgggcctgcgttgccgttcgcgtgggagggtgtttccctcttcgcctcgggtgcgacggctttgcgcgtgcggttggcgccggcgggtgagcatgcggtgtcggtgaccgcggtggatccgaccggtgcgccggtgatttccatcgacgcgcttcgtacccgtcgcctcaccctcgatgaggtcaacgcatctcacacccagctgagcgatgcgctcttcggcgtccaatggaccacggtcccgagcaccccggccgccgaccacccgtcggtagccatcatcggaaccgaccacctggggctcgccgaagcgctcagcagttcctctgctggcgcgaccacgaccacgaccgcggccgcgtacgagagccttgacgcgctgatcgcggcggggcccgaagtgtccgtccctgacgtcacactcatcggtctcaccaccgaggacgccatcgctcagtacgtgaacgaccacgacgccacggtggccggccaaggcaccatcggagccggcgcggcggccgtagacgcggctcgccgcctcaccgccgaggccctgcgcacgatccaggcatggttggccgacgagcgtctggcggcaaggcgcctggtcttcgtgacccgcggcgcggccgacgggcaggatgtcgccgcggcggccgtccagggcctggtgcgctccgcccagaccgagaacccgggcaccttcggcctcctcgacctcgacgggaccgaggcgtcgaccgcggtcctcggcgaggctctcacctccgacgaaccgcaactgcttctgcgcgacggacacctgcacgccgccaggctgacccgcctggcgtcgcccgccgacacggccgtgcccacggagtggaacgcggacggcacggtgctgatcaccggtggtaccggcgggctcggcgcgcagttcgcacggcacctcgtcgacaggtacggcgtccgcaatctcctgctcgtcagccggcgcggccccgatgccccgggaaccacggagttggtcgccgagctgacggcgcacggtgccgaggtggccgtgcaggcatgtgacgtggccgatggcgatgcggtggcggcgttggtcgccggcgtgccggatgagcacccgctgagggcggtcgtccacacggccggtgtgttggacgacggagtgatcggctcgctcaccgaggagcggctcgccaccgtcctgcggcccaaggcggatgccgcctggcatctgcacgaagcgacccgcggcctggacctggacgcgttcgtcgtcttctcctccgtcgcaggggtcttcggcggcgccggccaggccaactacgccgcggccaacgccttcctggatgcgctgatggcccagcgccgggcagcgggcctgcccggactctcgttggcctgggggccgtgggaccagaccggcggaatgacgggcatgctgtcggacgccgaggccgaccgcctcgcccgctccggcatcccgccgctctccgcggagcagggcctcgccctcttcgacgcggcactcgctcttgccggaaccagcacgccagacagggcagccggcagcgccgccgccagcacgtcgggaaccggcgacacgatcgccatcccggccgcggccctcgtcgcaccggtccggctcgacctggcggcgctggccgcgcagggtgaggtccccgcgattctgcgcggactggtgcggacccgcacccgccgtacggcggccggcggttccgtcaccgtggccggactcgtcaaccgcctgtccgggctcaccgccgacgagcggcgccaggaacttctcgaactggtccgcactcaggcagccctcgtcctcgggcacgccgatccggcgtccgtggactccaccgcacagttccgtgacctcggcttcgactcgctgaccgccgtcgagctgcgcaaccggctgagcacggccaccggcctgcgcctgaccgcaaccctggtcttcgactacccgaacaccgatgccctcgcggagcacctgcgggacgagttgttcggcgcggtcgagagcgaggtgcgggtgccggtccaggcactgccgccgaccgccgacgatcccatcgtggtggtgggcatggcctgccgtttccccggtggtgtgacctcgcccgaggacctgtggcgcctggtcgacgccggcaccgacgccatcaccaccttcccgaccaaccgcggctgggacctcgaatcgctctacgacccggaccccgcacacctcggcacctcctacacccgctccggtggcttcctgcacgaggcgggggagttcgacccggcgttcttcggaatgagcccgcgtgaggcgctggcaaccgactcccaacagcgtctcctgctggaatcctcctgggaggcgatcgagcgggccggcatcgacccgctgaccctgcgcggcagcgccaccggcgtcttcgccggcgtgatgtacagcgactacgggagcatcctcggcggcaaggagttcgagggcttccaaggccagggaagtgcgggcagcgtggcctcgggccgcgtctcctacaccctcggcttcgaaggtcccgccgtcaccgtggataccgcctgctcctcctccctggtcgccctgcacctggcagcccaggcccttcgggcgggtgagtgcacgctcgcgctcgccggtggtgtgacggtgatgtccacgccaggcacgttcgtggagttctcgcggcagcggggtctggcgcctgatggtcgttccaaggcgttcgccgaggccgcggacggcgtcggctggtccgagggcgtcggcatcctcgtcctggagcgccagtcggacgccgtgcgcaacggccacgagatcctcgccgtgatccgcggctcggcggtcaaccaggacggtgcgtccaacggcctgaccgcgcccaacggcccgtcccagcagcgcgtcatccgtcaggcgttggccagtggcggcctgtccacggccgacgtggacgccgtcgaggcgcacggcacgggtacgacgctcggtgacccgatcgaggcccaggcgctcctggccacctacggccgcgaccgcgaccccgagaacccgctgctgctcggttcgatcaagtccaacctcggccacacccaggcagcggccggtgtcgccggtgtcatcaagatggtcatggcgatgcggcacggcgtgctgccgcagaccctgcatgtcgacgcgccgtcctcgcacgtcgattggagcgtcggcgccgtcgaactgctcaccgagcagaccgtctggccggagaccggccgggtccgtcgcgccggtgtctcctccttcggcatcagcggcaccaacgcccacgtcatcctggaacagccggaggccgtgcagcgcctggcaccgggagcagcagagaccgtggagccggtcgccatcaagccgtcggcggaaccgtccctggtgccgtgggcgctgtccggcaagtcacccgaggccctgcgcgcccaggccgcacgcctccgtgacttcctggcggaacggcccgaaccgcgctcgatcgacatcggccactcactggccgtcacacgctcgcagttcgaccaccgcgcgatcgtgctggtcgacgatgcgaaggccccggcggacagcctggccgccctcgcggccctggcctccggtgtggccgatcccgccgtcgtctccgacgcggtatcgaccggcggttcggcagtgctgttcacaggtcagggtgctcaacgtctgggcatggggcgtgagttgtacggccgtttcccggtcttcgccgaggctctcgatgtcgtggtcgaccacctggacgccgccttgcccgcccaggccggtttgcgtgaggtgatgtggggcgacgatgtcgagttgctgaacgagacgggttggacccagcccgcgctcttcgccgtcgaggtggcgctgttccggctggtggagcgttggggtgtccgtccggacttcgtggccggtcattccatcggtgagatcgcggcggcgcatgtcgccggggtgttctcgctggaggacgcctgccgtctggtggccgcccgtgcgacgctgatgcaggcgctgccgaccggcggcgcgatgatcgcggtccaggccaccgaggacgaagtgaccccgcacctgaccgacgaggtggcgatcgcggccgtcaacggcccgacctccgtggtgatctcgggcgcagaagaggccacgcagaccgtggcacaacacttcgccgaccaggggcgccggacgaccgcgctgcgggtctcgcatgcgttccactcgccgctgatggatccgatgctggcggagttccgtgcggtggcggaaggactgtcctacgccaccccgtccctccccgtcgtctcgaatctgacgggctggctggccacggccgacgaactgtgctcggccgagtactgggtgcgccacgtccgcgaggcggtccgcttcgccgacggcatcaccaccctcgaagccgagggcgtgcggaccttcctggaactcggcccggacggcatcctgtccgcgctggctcagcagtccctcgccggcgaagccgtcaccgtgcccgtcctgcgcaaggaccgcggtgaggagtccacggccctgacggcccgagcgcatctccacacccgcggactgatcgaagactggcaggacttcttcgctggtgtgggtgcggggcgggtggagttgccgacgtatgcgttccagcgtgggtggttctggccggttggtcgggttggtgttggtggtgatgtgggtgctgtggggcttgggtctgcggggcatccgttgttgggtgctgcggtggagttggctgcgggtgcgggggtggtgttgacgggtcgtctgtcgttgtcgtcgcatggttggttggctgatcatgcggtgatggggcgggtgtttgctcctggtacggcgttgctggagatggtgatgcgtgctggtgatgaggtggggtgtggtcgtgttgaggaactgacgttggcggcgccgttggtgttgcctgagcgtggtggggtgcgggttcaggttgctgtggatgctcctgatgctgcgggtcgtcgtggtgtgggggtgtattcgtgtcctgatggtgtgggtcaggcggtgtggtcgcagcatgctgtcggtgtgttggcctctggtgcggctgaccaggtcggtgggttcggtgacggtggtgtgtggccgccgcagggtgcggtgtcggtggatgctgagggctgctacgagctgtttgcggatgctgggttcggttatggcccggtgttccaggggttgcgtgcggtgtggcgtcgcggcgaggaactcttcgcagaggtcgccctgtcggacgaggttgctgagagcgctgatacggcgaccggtttcgggttgcacccggcgttgctggatgcctcgctccatgcctcgcttctctcctcccttgaaggtcaatccgccgatggtgggcctgcgttgccgttcgcgtgggagggtgtttccctcttcgcctcgggtgcgacggctttgcgcgtgcggttggcgccggcgggtgagcatgcggtgtcggtgaccgcggtggatccgaccggtgcgccggtgatttccatcgacgcgcttcgtacccgtcgcctcaccctcgatgaggtcaacgcatcccacacccagctgagcgatgcgctcttcggcgtccaatggaccacggtcccgagcaccccggccgccgaccacccgtcggtagccatcatcggaaccgaccccttcggcctcgcagacggcctttcggacgccttgcccctggtcgaggagcgcggtgacctcgcggcgctcgcagcgtcggagcacccggtaccggacctcgtcctcgtcccggtagcgggcacccggcgcacaggcgtacctgcggacgccgaaggacacaccgacgccgggacatccgacatgctccgatccgtgcgtgaggccaccgcacaggtactggagcagatccagcagtggttggcggacgaccggttcgaggcggcgcggctggtgttcgtgacgcgcggggcggtttccgtgggtgagggcggcatcgccgacctggcggcctcggccgtctggggtctggtgcggtcggcgcagtcggagaatccgggctgcttcggtcttctcgacctcgacctcgacctcgcccttgactccgaccttgcccccgaggtcgacatcgagcgcgaccgtgaccgcgatccggtcggtgggaccgtgcagcccgcgctcgccgcggccctgcacgcgaccgccgacgagccgcagttggcactgcgcggcgggaccgtgcaggccgcccgactgacccgaatccccgcgccgcagaccgaccgtgccgagaccgaccctgccgagaccgaccgtccggagatcgacacccggcggcccggcacggtgctcatcaccggtggtaccggtggcctcggtgggttgctcgcccggcacctcgtcgccgagcggggggtacggagcctggtgctcgccagccggagcggtctcgcggccgagggagcggagaagctggtcgccgacctcgaagcgctcggtgccgtggtggccgtgcagacgtgtgatgtggccgatggcgatgcggtggcggcgttggtcgccggcgtgtcggacgagtacccgctgacggcggtcgtccacacggccggtgtgttggacgacggagtgatcggctcgctcaccgaggagcggctcgccaccgtcctgcggcccaaggcggatgccgcctggcatctgcacgaggcgacccgcgatctggacctggacgcgttcgtcgtcttctcctccctcgccggcgtcctcggtggcgccggtcaggccaactacgcggcggcgaacacgttcctggacgccttgatggcgcagcgtcgcgccgccgggttgccgggtgtgtcgctggcgtggggtccgtgggaccgggccggcggcatgacggggaccctgtcggacgccgaggccgaccgcctcgcccgctccggtgttccgccgatctcggcggagcagggccttgcgctgtacgacgcggcgaccgccggtgagcggccgctggtggtgccggtgcggctggacctcgccgcgctccgcgggctcggtgatgtcccggcgctgctgcgcggactggtccggacgcccgcgcggcggaccgcggcggccggtgcggcgccgtcggccgatgtgctcacccggcagttggccgggctcggcggggcggagcaggaggaggtcctgctgaggctggtgcgcggtcaggccgcggtggtgctcgggcacgccgacggctcggcgatcggtgcggggcgacagttccaggagttgggcttcgactcgctgaccgcggtggagttccgcaaccgactcaacgcggccaccggactgcggctgccggccaccctgctgttcgactacccgacgccggccgacgtcgtcgggcacctgcgcggccggctcggcaccggggaggtgtcgggtgcgggctcggtgctggcggcgctggacaaccttgaggcggtgatcgccgggctgtccctcgacgacgcgggggagcaccagttggtggccggccggctggaggtcctcagggcgaagtgggcggacatgcgaagcgcggagggagctgtggacggcggtgcggacgtcgacatcgaggaggcgtcggacgacgacatgttcgcgctgctggacgacgagctggggctgaactgagccgctccgcatgagcagttccgcaccagaagttccacagtggcctggtccacagtgacctggtccacagtgagctgttccacagcgacctgttccgcggcggttccgtagtgagccgttccgcttaggcgggaaaccggggccccggtggtcggacgcttgattccggccaccgggagcgtcaaaccggcctcttctaaagaaagggaaagaactagggaaacacccacagcccgatcatgtgcaatgaattccgtggctcggaaaaccattcgcgggccatggagttacggtgtgatcacgtgtccgtacggcagtgacggcgtgcacgggttgccacggcaggtccccggccgaggcgtctccccgctgctgcccggcggtgcgtgccgcttggttcgtccctaggaggtccccccatgaccacgtccaccgaggagagcctgtgggcccggtgcttccatccagcaccggccgcccccgtccggctcttctgtttcccacatgcgggcggctcggcctccttctacttcccggtgtcggcccaactgtcctcggttgccgaggtgttcgccatccagtacccggggcgccaggaccggcgcaaggaagccggtgtcagtgacctcgcgaccttggccgaccaggtctacgacgcgctgcgccccctgctgaaggagcggccgagcacgttcttcgggcacagcatgggcgcgacgctggccttcgaggtggcccggcgcttcgaggccgacgacggtgacctggtccggctgttcgcctccgggcgccgggccccctcccgcgtgcgtgaagaggccgtgcaccggcggtccgacgacggcatcgtcgaggagctgaagctgctcgccggcaccaacaccgcgctgctcggcgacgaggagatcctgcggatgatcctgcccgcgatccgcagcgactaccaggccatcgagacctaccgctgcccgcccgacgtcaccgtccgggcgccgctgaccgtcctcaccggcgaccgcgacccgaagacctccctggacgaggccgaggcgtggcgcggccacaccaccggggacttcgacctcaaggtgcttcccggtgggcacttcttcgtcagctccgaggccccggcgatcatcgatctgctccgggcgcacctcgccggcaacggctagcgggcgcactgcggcaggccggcggtgccggtctgccgcacggcccccgcgccgcctgagacggcaccatgccacccggcgacgcgcgttgcgtgcgcctgtggagcaccgtcccgcgtgcgtacgcgggcgcgcggaggacgtgctcggccggccggatgtcctggaggagaccattcggaaaacgtcaaatgtctgacagctgctgctcatttactccagcccgcactatatgatcttgtggtggggcatgtacggagcgtgccactcgttcgctcctggtgcatccatcccgaccgtccggatttgtgtgcaccggacggccgtggtcctggtacgcgtcggcgcgaggtcggctcctgttctcaccccacgtggaggaacgcgtgatgcggaagcagtcgggttcttccggcttactgaccacgctggtgggacgcgacgacgaactgcgcaccctcgcccggcacgccgcggccgcccgcgacgggcgggccggcctggtcctgctccacgggcccgccggcatgggcaagaccagtctgctgcggtccttcacggcgagcgatgtctgccgcggcatgacggtgctgtacggcacctgcggcgagaccgtcgccggcgccgggtacggcggtgtgcgcgaactcctcggcgggctcggcctgagcggcggcgacgcccggcgctcgcccctcctggagggcctggcggcccgcgcgctgcccgcactcaccgcagaccccgccggtcccgacgccgccacgggtgcctacccggtgctgcacggcctgtactggctcgccgcccgcctcatggcccaacggccgctggtcctcgtcctcgacgacgtccactggtgcgacgaacgctccctggcctggatcgacttcctgctgcgacgcgccgaggacctgccgctgctggtcgtcctggcctggcgcagcgaggccgaaccggtcgcgcccgcggtgctcgccgacatcgccgcccagcgccgccccaccgtgctcggcctgcacccgctcggccccgacgacataggcgaaatggtgcgtcgcgtcttccggaccacggccgcaccgtcgttcgtcagccgggtcgccgccgtgtccggcggcaatccgctggccctcgcccgcctcctcgacgaactccgcgccgagggcgtccggccggacgccgccggggagcgccgggccgccgaggtcggcagtcacgtcctcgcccgctcggtgcgctgcctgttggagcgccggccgccctgggtgcgcggcgtggcccgtgccatcgccgtactcggcccggagtgcaccgagttgctggcggcgctcgccggcgtcccggccgcgaccgtcgacgaggccctgttggtgctgcgcagggccggcatcctggccgccgaccgcgtggacttcgtccatgacgtcgtccgctccgcggtgctcgacgacgtcgccccgcccaccctggccgaactgcgcaccaacgccgcgctgttgctgagcgacgccggccgcccctccgaggagctcgccggccagctcatgctgctgccggtgctcgaccagccgtggatggccgcggtgctgcgcgacgccgccgcccaggcggagagccgcggcgccccggaggccggtgtgcgctgcctctaccgggtgttggaggtggagccggacaacgttgccgtccgcatccagatggcccgcgcgctcgccgagatcaacccgcccgaggcgatgcgcctcctcaaggaagcgctctccctcgccggggacgtccgcacccgcgcccaggtcgccgtccagtacggcttcacctgcctcgccgtgcaggaatccccgtccggggtgcggatgctggaggacgcgctcgccgagctgaccgccgaactgggccccgaaccagggcccgtggaccgggagttgcggaccctcgtggagtccgtgctgctcatcgtcggggccgacgagaaggtgacgatcggtgcggtccgcgaccgggcggcccggctcaccatgccgcccggcgacacaccggcccagcggcagatgctggccatgaccaccgtgctgaccgcgatggacggccgggacgcccggtcggccgtcgaccaggcccgccgcgccctgcgcgcacccggcgtcgagctggaaccctggtcgctgctgtccgcctccttcgccctctccctggccgacgaggtcgccgacgcgcagtacgcactggacctcatgctccagtacggccaggacaacgcggcggtgtggacgtacgtcctggcgctctccacgcgcgccctgctccaccacggggtgggcgccttccccgaggccctggccgacgcccagaccgccgtcgagatcctcggcgaggagcgctgggcggacggcgccgtgctgccccgtgtcgcgctggccaccgccctcgtcgaccgcggcgagcccgagcgcgccgaacacgtcctcgacggcatcacccgcccccgcctcgaacgcttcgtcatcgaataccactggtacctccaggcccgcgcctacgcccgctgggtccgcggggatttccaaggagccctggacctccttctcgcctgcggtcggtccctggaggagtcgcgcttcagcaacccggcgttcgtgccgtggtgggccgatggcgcggtgctcctggcgaccctggaccgccacgaccaggcgcgcgaactcgccgcatacggaagcgagttggccgagcgttgggggacggcgcgcggcctcggactggccttcatggcccagggcgtcgccgcacccggccgcgccggcatcgatcacctcaccgaggcggtctcgctgctcgcggactccccggcccgggccatggaggcccgggccgaacttcttctcggacacgcccacctgaagcgcgacgacctgcgggccgcccgggaacacctgcgcgccgccgccgacctcgcccagcgctgcggcgccgtgaagctcggcgtcgacgccagaaaactgctggtcaccgcgggtggtcgggtacgcaggatgaccgcctccccactcgacatgctgaccgggatggaacgcacggtggcggacctcgcggtgaccggcgcgagcaaccgggccatcgcggaagccctcttcgtgactgtaaggaccatcgaaacccatctcacgagcgtctaccggaagctcggggtcggcgggcgtgcggagctgtccgccgtcctggagaccaggaccgccacctccggtcggcagccgccggcctgggtctcccaggcacgcggacgcgcttgagacgaacaggacgagaggtagcggtgccccggagcaaggcgcggaaccaaccgaccacctgcacgccgcagtgcgcacccgacgcccacggcgaccccaccatgctcctcgaatgcggccgggaacagcggctcatcggcgacctcctgcaccgcctcggccaggggcggccatcggtgctcagcctgaccggccggcccgggcacgcccagaacgccctggtccgctggggcgcgtgccgggccaggcacgacgggctgcgcgtcctgcgagcccaggcgacgcccgcggaacgggaactccgctacggcgccgttctccaactgctggccgtcctcgacggcccgcacggcagcaccctggacgccgcgatccgccacgacggtcccccgccactgcccgtgcccggcatcgaggaggtgctgcggcgcaccggcacggcacccaccctggtcgtggtcgaagacgtccagtggttggacccggcctcgctgacgtggttgcagatcctgctgcgccacctcgggccggacaccccgctcgccgtcctggccagcagctgcggtgacaccacggccttcgacaccgacccgaaggcccccgccgtcccggggccgccggacaccgtgcccgtcgcgcgcttcgtggtgcccgcgctcaccgaccgcggggtcgccgccaccgtccgcgccgtctgcggcacccccggcgacgaggagttcatcgccgcgctcacctccgccaccgccggcaaccccgccatcctgcgggacgccctgcgcgccttcgtcgaccacggcctccccgccgacgccgaccacctcccggagctgcacgccctcaccgctggcgtcgtcggcgaccacaccgtgcgcgccctggacggcctgcccgccgaagtcaacgccgtcctgcgggccctggccgtctgcggcgacctgctcgacttccaccgagtccgggccctcgccggcgcgcactcgctgtccgaggaccggatccgcaccctgctggcgagcgtcggcctgaccgtgtccgtcggcgacaaggtgcacatccgcttccccgcctccaaggcacgcgtcatcgaggacatgcccgccgcggagcgcgccgatctgtacgtccgcgcggccgaactcacccacagttgcggcgtcaacgacgaggacgtcgcccatctgctgctgcgctcgtcgccgctcggcgcaccctgggtcgtgcccctgctccgccgcggattcgccgccgcgctgcgccgggaggaccaccaccgggcctgtgcctgcctctcccgcgccctgcaggaacccctcgacccccgggaacgcagcctgctgacgttggaactggccgcggccgaagccgtcgcccggccggaggcgggggatcgacgcctgggggaactcgtccgcagcaccgtcgcggacaccgaccccacgtcgtccggtgagggggtgggggtccgcgccatcgacctggggttcgcccggggcaacagcgaatgggtccgccgcaccgcgggcgaggccctgccgtacgccgggccggccgaccgggaggaactggtcgcgctgttctggttggccgccgtgcgggacgacgacgcgccgatgatccccgtggtgccccggttgcccgaccggccggtgccgccggcccaggccggcgcccgtgcctggcagctggccacggcgggggaggacgcggacaaggccaggaagctcgcccggatcgccctcaccggcggggtgaacgagagcctgatgatgccgaaactggcggcctgcgccgcgctgttcgccaccgacgacaacgacgaggcggtgcacggcctggacaccatgctcaccgccgcccgcagtgcccacctgcgcagcatggccgcccgcattttcaacctacgggcccggatacacctgtgcgcggcccggctggaggccgccgaacgcgatctggacagcgccgagcgcgccctgccgccgacgagttggcacccccgtgcgctgcccaacctgatcgccacccgcatcctcgtcagcatggagacgggccgcccggaccgggcccgccgactcgccgaggccccggtccccgccggcggcgaggagggtgtgtggtggcccgccctgctgctcgcccgcgcccgtgtggccgccgacgacggtgactgggaggaggccctgcggctgtcgcgggagtgcgggcgctggctttttcgccggcactgggccaacccggccatgctcagttggcgcccgctggccgccgaggcgtgtctgaagctcggcgacgtgacggaggcgcgccggctgcgggacgaggagctgttcttcgccgaccgctggggcaccgcgagcgcccgcgggatcgcccgcctgacgacgcggcgactcttcgacgacgacggcgaccgggccgtccggcggatccgcgaggccgccgccctgctccgcgactcgcccgcccgcctggcctacctgtggagccggctgagccaggccggtgccgagacggcccacggcgacaccgccgcggccgcacgctcctggcaggcggtcgcccggatgaccgccgcccaccccgccagccgcctcgccaccgccgcccgcaccctgaccgtcccgtccgttccggtcgccaccgcgccgcccaccgccgtcgtcccacccggatggcgcgacctgtccgaggcggagaaggacaccgtgctgctcgccgcccgcggccacggcaaccgccagatcgccgaacaactcgccgtcagcaggcgcaccgtggagctccggctgagcaacgcctaccgcaagctgaggatcggcggacgcaaggagctgtacctgctcctggaggcgctggaaggaccggtcgcggatgcttcttgagcgggagaacgaactggcccggatccgggccgccctggacgccgcggaagcgggcgactcctcgctcctcctgatcaacggtcccctcggcagcgggcgttcggcgctgctgcgccggataccggagctggccggcgacggcacccgcgtcctgcgggccagcgccgcctggcgggaacgcgacttccccttcgggatcgcccgccaactcttcgaccacctgctgtccggggcgggcggcgcagggccggccgaacgcaccgccggggcagagcacttcagccgactgatggacaccggcgaccgccctaccgggaccggccccgccctggaggtctcccaggcagtgctccagggcgcccaggcgctgctcgccgacgcgtccgcggagcggcgcctgctgatcctggtcgacgacctccagtgggccgacggcccgtccctgcgctggctggcccacctcacccggcggctgcacggcctgcgggcgctgctggtgtgcacgctggccgacggcgaccaccggggcaggtaccccctggtccgggaggtcgccggcgccgcgcacaccgtcctgcgcctggcgccgctgtcccgggacgccacccgcgtcctgctcgccgggccccagggccggccgccgcaggacgcactggtgcgcgccgtgtacgaggcgtccaggggcaacccgctgttcctgaccgccttccggagcgctctgcgcgccaccggaaggccgcccggcggcgaccacttcggcgccgtccgggagctgagcccgacggtgctgcgcgatcggctcgcgggccatctgcggatccagccgcagccggtgcgcgaggtcgcggtggcggtggccgcgctgggcgaccacagcgatccggtgctgctcgcccagctcgccggggtcgatgaaatcggtttcgccggtgcccgccgcgcgctggtggacgccggcctgttggcccggggacgggacgtccgcttcgtccacggcgtcgtccgcgatgcggtggactccctgctcaccctcgacgagcgggaacgctcgcacgacgacgccgccgatctgctgtaccgctgcgggcggccggccgagcaggtcgccggccatctgctggccgtggtccacccgggccggccctggtcggaggcggtcctgcgctccgcggcccacaacgcgctgcgcgccggccggcccgccgacgcggcccggtacctgcgccgcgccctgctgcaccaccgcacccaggacggctgccgcgcccgcatcctggtcgatctggccaccgccgagcgcgccctcgaccccgatgcctgtgtacgccacgtcagccaggcggtcgcgctgctggacacctcgcgggatcgggccgccgccgtgttgcgcatcccgccgtccctgctcgccgcccccagcccgtccgccgtcgagttggtgcggcaggccgccgccgggctcgacgaaccggggcagcgggacgaggagggagccgacgaactcgccctgcgcctggaggcgtggctgcggcactccggccacgagaaccccgtcgagctggcgtcctcggtggcgcggctgcggcgcatgggggcacggccgccggtggacagcgtcgccgaacgcgagttggtcgccgtgctgttgagtgcgggcgcgctcagcggccggctcagcgccgcggagatcgccgacaccggcaaccgcatcctcgaacgtgagccggccaccgccgcccatgcccacaccccgctgccgctggtgatgctctcgctgttcgtcgccgagtccgtgcagggcgtggcctcctggctggccagcgaacagcacacccggcgccggtacgcgaccggcgcggacgatgtgctgctgaccgccgagcgggccttcgtcctggtgacgcagggccgcccggccgccgcgcgggagcacgtcgaacgcgccctggtcatggacgccggcgactggtcggaacccgccgtcatgatgttcgccgcggtcgccttcgaactgcgcgacccggccttgagcgaacgcatcctggaacggatccgcgaccgccggccggccggactggcgctcaccgccaccggtcagatgctccaggccgccgtcgacgtgcacttcggccgggggcgggacgccctggacacgctgctggcctgtggccgacgcctggagaccgtgggatggcgcaattccgcactgctgccctggcgtccgtatgcaatcgggctgcaccagcggctcggcgagaccgatgccgcgctgcaactcgccgaggacgagctgaggtgggcccgggagtggggtgcgacgacgaacctgggccgggccctgcgcctgaagggctggctgttgcaggacgagggactggatctgctgcgtgagagcgtcgagatcctccgcgcttcgtcctacgcgacggaactggcgcgcaccctcgtcgtcctcgggcgtcggctgccgggtgggccggaggccgaggcggtgttgcgggaggccgcggggatcgccgccgcctgtggtgttccctggctcgccgaacgggccgaactcggtctgggcagtgccatcgtgccgccggtcgccaccctgacccccagcgagcggcgagtggcgtcgctggtgagccggggcctgaccaaccaggccatcgcgaccgaactcggtgtgagctcccgggcggtggagaagcacctcaccagcgcctatcgcaagctcggcgtctccggccgccgcgagttggtgaatgcgctcccgggtcgttgacgcccgcggccgtcccgttccggacgatcacaatcctctgtgcctgtcagccctgtgggtgcggcgtcgttgtcgtacgcccgtccggtcatgacagcaatcctcaacaaaagctcaaacggaagcgggggcaggtgcatccaccccatcaccaatgtctcgtatgttacttttggcccaccgtagttgggactctgcggaccgtacctcgtcaagtacggaccacggatttaggggtgcgtagatgtgtcgcgttgacgtgccgagttgtggctaactacgctccgtttcacggaaatcgaaactcttcggcgtgaatcgcggcgaacttcgatcgaattctggattccgtttctcagaaggctaaaagacgacgggggttatccgaaaggatggcggtctcgtgactatcactcacctcactgactcgaatcaccgtacgaccggcggggtgatatccgctcagaccgcaccggccggggagtccgtcggccccgggctgatggcgtccctcgaccgtgacctcaccatcaagcacgccaaccaggagttccgccgccgcttcgacgattccgccggtgacgtctgcggtcgcagcttccgggacctgatgcacccgagcgtgcagcagccgctgatgcgccagttctcccggctgatcgagggcaagcggcaccgcttcgcctcgcacgtggtcgccgtgggcgcccaggacgcggccttcgcgggcaccctcaccgcctccgcggtcaccggcaagaccccggacatcgccgggatcctggtgctcatggactcgtccggcgccgccgacgccgccgatgccggcgtcgtgaccagccagaagaagttcctgaccgagatcgatgcgcgcatcctcgaaggcatcgcggccgggctgtcgaccattccgctcgcctcgcggctctacctcagccgccagggcgtggagtaccacgtcaccgggctgctgcggaagttgcgggtgcccaaccgcgccgcgctcgtctcgcgcgcctactccatgggcatcctgaacgtcggcacctggcccccgaaggtcgtggacgacttcatcaagtgacgcccggccggcctgtcccgcaccggccggccaccgtcggaccgctgtcccgcacgcccgtgtcgccgacgcccgcctctcacggggcgatgcccggcggcacgggcgtttcgtgccctggtcgatgtttatccattctcacgttacgaacccgcaatgctcatgcgcgcgattccggccacttttcgttccgtcgtaaccaaactgcccgtcatatcgtttccactgaccgtttctgtggtccgcggtgtgccacctgggccccactccgacgcgcccgcgacgggtcgcgagcggcctccgaatactcacggtaacccccgttcctcctggtggagttccccgcgcgtcacattcctccgtgcctcgtgcggcgtggctcgcccgctttccccgccgccgcgacagccattgttacaacggcacgacagagcgggggtggtcgacccgtccgcggtgcggcgcagtcaagcggaacctctgctcgatgttcgtgccaccccgaactctgtgttcttggtgaccgttttcaccaatgccccgcccgttcggtggcgaatccgccgcccgttcctggccacaacggatcgcttcggccgcccaccacggccggcgcagccgaggcttgttggaatcacccccacccagtcggggcgccgttgtggcccggacacgcaggaggaacaccgtggatgctgagggccgccgcagggacatgctggagctgatccggcgcagcggatccgccgatgtcgtgcgtctcgccgaggagttcgccgtcagcaaggaaacggtccgccgggacctgaacgtcctggagggccatgggctgatacggcggcggcacggtggcgcctatcccatggtgcggccgggctccgaggccgtcttcgtctcccggaccgcacagccgatcccggaggagtcccggatcgccaccgcggccgccgaactcctcagcgaggccgagacggtcttcatcgacgagggcttcaccccgcaactcatcgccgacgccctgccgcgcgaccggccgctgaccatcgtcaccgcctcgctcccggtggtcagcgccttcgcgacgagcccacaggccaacgtgctgctcctgggcggccgggtccgccggggcacgacggccaccgtcgaccactgggccgtccacatgctgtccggcttcgtcatcgacctggccttcctcggcgcggaggggatctcgcgcaggtacggcctgaccacccccgacccggcggtcgccgaggtcaaggcccaggccatccgcgtcgcgcgccgcccggtcctcgccggggtgcacaccaagttcggcacggcgagcttctgccggttcggagaggtgggcgacctggagacgatcgtcaccggcgccggcctgcccgtcgccgaggcccaccgctaccacctcatgggccccaaggttttacgggtgtgacgccgccggggcgtcccgccgcccgcccacggcctggcgcgcgccggtgcgggtcagccgcgtcgcgcgtccgtcggttcccgccagagtgcgagcggtgtcacccccacccggtagccctcctcgtcgaggagatggccgccgtgcttcatgtgccagagggcgaccgcgcgttcggtgacggtcaggtccgcggcccgttcggcgagtcggacctcgaagcgctgggcgtcgtcgagggagcgcacccaggccaccaggtgcaggttgtgccggctgatgacgctcgcgcacaggcggacctcgcgcatcccggtgacccggcgggtcacctcgcgcagcctcgcggccgggacctgcccccagaagctcaccgtgaccggccactcggacagcgggcgggcgacctcgcaccgggcgtgcaacatgtccgcggcgaagagccgttggacgcgacggcgcacggtgtcggggccggcgccgcactgctcggccagcgcgcggtaggtggcccggccgtccacggacagcgcggtgaccagctgttggtcgagctcgtcgaggacgaaggcgggggtgtccgtgcggtgtctggacgcgtcggcggcgagccgggcgacctggtgccggccgagggcccgcaggcgccaccggctgccctcggtgtgcaccgggccggccaggtgcgtccgggcggcccggacgccgtccaacgcggcgaggtcgtgggtcacccaacgggagagcatggccggatcgcgggccatgacgttgagttggaggtcacggtccccggtgacgtgggagagcgccaccacgtgcggcgcggcggccaacgcccgcgcgacgtcgagcagtcggccgggagcgcagtcgatctcgacgaacgccaggcacccctggcccgacgcggccagcaccggggccggatggcagctgatccaggcggcgccggtctcgaccagccggttccagcgcctggccaccgtcacggcgtccagtccgaggacggagccgatccgggtccagctggcccgcggcgtgatctgcagcgcgtgcaccagggcctgatccacatggtccagggaccggggggtctgcccggaatcctgcgccacgggccacctccttgcgtgtttccggcggattcgggccgccggtcggctcaaccttcagcctggactcgggtacggccggaccgtaccaggcaacccccggagcaacaggagtgggattcggcatgtcggcagtggaacgcgccaaggaaatgcaacccgagttggagcggctgcgccggtcgctgcaccgggagccggagttgggccttgcgctgccgcgcacccaggagaaggtgctcgcggcgctcgacgggctgccgttggagatcaccccgggcaccggcctcacctcggtgaccgccgtcctgcgcggcggccgccccggcggcgcagtgctgctgcgcggcgacatggacgcgctgccggtcaccgaggagagcggtgtgccgtacgcctcggagatccccggccggatgcacgcctgcggacacgacctgcacaccgccggactcgtcggcgcggccaggctgttggccgaacgccgggaacgcctgcacggcgacgtggtgttcatgttccagcccggcgaggagggccacaacggggccggcgcgatgatcgaggagggcgtgctggacgcggcgggcaagccgctcgacgcggcgtacgccctgcacgtggcgtccaaccaggtgcccggcggcgtggtcatcacccgctccggcaccatcacctcggcctccgacctgctgacggtgacggtgcggggcgagggcggccacggctcgacgcccgccacggccaaggacccggtcccggcggcctgcgagatggtcaccgcggtgcagaactgggtgacccgcgccttcgacatcttcgacccggtcgtggtcaccgtcggcaccttccacgccgggacgaaggcgagtgtcatccccgacaaccgccgagttccaggccacggtgcgcagttattccgaatccgcccgggaccggctcgccgaagggaactgccccgtctggtgcgggccatcgcggccgcccacggcctggaagcggaggtcgactacctccggcactatccggtcaccgtcaacgacacggacgagaccgccttcgcggtggccaccgcccgcgacctgttcgcgcccggcgaggtgtgggagtcgccgatacccaccaacggctccgaggacttcgcgtacgtcctccggcgcgtccccggcgcgatgctgctggtgggcgccgcccccgaggggagcgactggcagcacgcgccgatgaaccactcgccgcgcgccgtcttcgacgaccgggtgctgtaccggcaggcggcgctgctgaccgaactcgccgcgcgccggctcgcggccaccgcgccggccgagcccgccgtggcgggatgacaccgccgccgcacgcgtggggcccgcacgcgtgcggcgtacgggccctggccggtctccttcccggctacttgcgcgcggggcactccttccacgcgaagtggtagagggtgttgatgctgccgtcggtggagtcatggccatgtagctggtggccttggggtcagccccgctgccgt

SEQ ID NO: 36 - protein, 352 aa, Streptomyces noursei
MSFTYPVSMPWLQGRELDYVTEAVGGGWISSQGPYVRRFEEAFAAYNDVPFGVACSSGTTALTLALRALGVGPGDEVIVPEFTMIASAWAVTYTGATPVFVDCGDDLNIDVSRIEEKITPRTKVIMPVHIYGRQCDMDAVLNLAYEYNLRVVEDSAEAHGVRPRGDIACFSLFANKIISAGEGGVCLTHDPHLAEQMAHLRAMAFTKDHSFLHKKLAYNFRMTNMQAAVALAQTEQLDTILALRRDIEKRYDEALRDIPGITLMPPRDVLWMYDLRAERRDELCAYLAGEGIETRVFFKPMSRQPGYFSADWPALNAARLSADGFYLPTHTGLTAQEQEFITGRIRAFYGVA

SEQ ID NO: 37 - protein, 9477 aa, Streptomyces noursei
MDNEQKLRDYLKLATADLRRTRRRVHKLESAAQEPVAIIGMTCRYPGGVRSPEDLWRMVEAGEHGVTPFPTDRGWDLEALAAAPTASGGFLHDAPDFDADFFGISPREAVAMDPQQRVVLESAWEAFERAGIDPTSVKGSRTGVFIGAMAQDYRVGPADGAEGFQLTGNTGSVLSGRISYTFGTVGPAVTVDTACSSSLVAVHLATQALRAGECTLALAGGVTIMSGPGTFIEMGRQGGLSADGRCRSFGDTADGTGWAEGVGILVLERLSDAVRNGHEILAVVRGTAVNQDGASNGLTAPNGPSQQQVIQQALVNARLAAGDIDVVEAHGTGTTLGDPVEAQALLATYGQNRPADRPLLLGSVKSNLSHTQAAAGVAGVIKMVMAMRHGTLPRTLHAEEPTHHVDWSQGAVRLLTDTTDWPATGAPRRAAVSSFGISGTNAHTIIEQAPEPQPEDAATAQDDAAGSTPATAPVVPGVVPVLLSGRTPDALRGQAAALRAALDTGRRPDLLDLAHSLATTRAGFEHRAVLLATDHPALTDGLTALADADDPAAAPAWITGTTRAETRLAVLFTGQGAQRLGAGRELAARFPAFATALDAALDAFTPHLDRPLREVLWGTDAALLDRTAYAQPALFAVEVALYRLIESFGVRPDHLAGHSVGEIVAAHLAGVLSLADAATLVAARGRLMQALPDGGAMIAVQASEADVAPLLAGHEDQVAIAAVNGPSAVVLSGAEATVTALAEQLAADGRKTRRLRVSHAFHSPLMEPMLDAFRAVVEDLTLQPPLLPVVSNLTGKPATVAQLTSADYWVDHVRHAVRFADGIDWLARHDTTAFLELGPDGVLSAMAQDCLDAADADAVTLPALRAGRPEEHTLTTALAGLHVHGATLDWTGCFAGTGARRTDLPTYAFQRRRYWPKALQSGTADLRSVGLGAAHHPLLSAAVSLADAGGTLLTGRLSRQTHPWLADHTVRGTTLLPGTAFLELAVRAGDEVGCDRVEELTLAAPLLLPEQGGVQVQLWIGNPDVSGRRTVNVHARPDTGDDTPWTAHATGVLTTADASRQLPASSEQGGTPLAGDPHPALDAAQWPPAGAEPLPLDGHYDRLADGGFGYGPVFQGLRAAWRGGDVVYAEVELPEAGRSDAEAFGLHPALLDAALHAAPFTGLGERGRGGLPFSWEGVSLHAGGATTLRVRLTPVADDALALTVADGTGAPVLSVDSLVLRSVATQQLDTAAAVARDALFRLDWTPVQPTATDPGPVALLGADPFGLLTHAGFADAPAYPDLAALAAADGPVPTTVVLSLAGTGDDAADPARSAHRCAAEALAAVQTWLDHHERFAAARLVFVTRGATVGRDVAAAAVWGLVRSAQSENPGCFALVDLDPDGAVGAAALVAALVSGEPQLAVRGDVLRVARLVRRPLTEVGAGADGTGDGVGDGSGVSFSGEGAVLVTGGTGGLGAVLARHLVAEYGVRDLLLVSRSGERAVGAGELVAELAGVGARVRVVACDVTDRAAVVELVGGHAVSAVVHAAGVLDDGMVGALTGERLSAVLRPKVDAVWHLHEATRGLDLDAFVVFSSLAGVFGSPGQANYAAANAFLDALMTRRRAEGLPGLSLAWGPWEQSGGMTGTLTDVDAERLARSGVPPLSVAQGLALFDAAVAGTDATCVPVRLDLPVLRARGEVPPLLRSLIRVRARRAAVAGSATAGNLAQRLRRLDEDGRDEMVLDLVRGQVALVLGHATGGDVDAGRAFRDLGFDSLTAVELRNRLNTVTGLRLPATLVFDYPTVRHLATYVLDELLGTDAEVATVQPAAVAVADDPIVIVGMACRYPGGVSSPEDLWRVLTEGTDAVSGFPTNRGWDVESLYHPDPDHPGTSYTRSGGFLHEAGEFDPGFFGMSPREALATDSQQRLLLESSWEAIERAGIDPVSLRGSRTGVFAGVMYSDYSAMLASPEFEGFQGSGSSPSLASGRVAYTLGLEGPAVTVDTACSSSLVAMHWAMQALRSGECGLALAGGVTVMSTPAVFVDFARQRGLSPDGRCKAFADAADGVGWSEGVGVLVLERQSDAVRNGHEILAVVRGSAVNQDGASNGLTAPNGPSQQRVIRQALASGGLTAGDVDVVEAHGTGTTLGDPIEAQALLATYGRDREPERPLLLGSVKSNLGHTQAAAGVAGVIKMVLAMRHGVVPRTLHVDAPSSHVDWSEGAVELLSEQAAWPETGRVRRAGVSSFGISGTNVHVIVEQAPGAKAIAAAGAARRTPGAVPVLLSGRGRSALRGQAARLLGHLQARPDAELVDVALSLATTRSRFEQRAAVVAQDRDQLIASLGALAADRPDPAVVEGEAAGRGRTAVLFTGQGSQRAAMGRELHEVQPEFAAAFDAVCAVFDPLLDRPLREVVFAEDGSDEAALLDETGWTQPALFAVEVALFRLVESWGVRPDFVAGHSIGEIAAAHVAGVLTLEDACRLVAARATLMQALPTGGAMIAIQATEDEIAAHLDDTVAIAAVNGPQSVVISGDEEAAETIAATFAERGRKTKRLRVSHAFHSPRMDGMLDAFRIVAEGLTYRAPRIPLVSDLTGRRADDAEVCTAEYWVRHVREAVRFADCVRTLRDAGATTFLELGSDGLLTAMAEDTLGDDHDAELVPMLRAGRAEELAAATALARLQVRGVDVDWAAYLAGTGARRTDLPTYAFQHAYYWPQLPTPAAALAAADPADQQLWAAVERGDARELADILGLGEQDLTPLDSLLPALTSWRRGNQEKHLLDTLRYRVEWTRLSKPTAPVLDGTWLLVASDATAADQPALLDGLADALGSHGARVRRLLLDDSCADRAVLAERLARTADVDAATQVLSVLPLDERDADDCPPLTRGLALTVALVQALADTGAQGRLWTATRGAVSTNPADPVTHPVQAAAWGLGRGVALEHPRLWGGLVDLPQVFDERAGQRLAGILAVKDAPDGEDQVALRATGVSGRRLVRHTVEALPTAAEFTATGTVLITGGTGGLGAEVARWLARAGAQHLVLTSRRGPDAPGAAELRAELEGYGPSVSVVACDVADRDALAAVLTALPEELPLTGVVHTAGVGHYGPLDTLSTAEFAGLTAAKLAGAAHLDALLADRELDFFVLFGSIAGVWGSGNQSAYGAANAYLDALALHRRARGLAATSVAWGPWAEAGMAADDAVSETLRRQGLGLLDPAPAMTELRRAVVRQDVTVTVADVDWQRYAPLFTSARPSALIAGLPEVRALAADERTEQDATGASEVVTRVRALAEPEQLRLLTDLVRTESATVLGHSSADAVPEGRAFRDVGFDSLTAVELRKRLGAATGLSLPSTMVFDYPTPLELAQYLRAEILGAVLEVAGPVATGGADDEPIAIIGMACRFPGGVSSPEQLWDLVASGTDAISEFPVNRGWQTGHLFDPDPDRPGTTYSTQGGFLHEADEFDPTFFGISPREALVMDPQQRLLLETTWESFERAGIRPETLRSTLTGTFVGSSYQEYGLGAGDGTEGHMVTGSSPSVLSGRLSYVFGLEGPAVTVDTACSSSLVALHLACQSLRNGESNLAVAGGATIMTTPNPFIAFSRQRALAKDGRCKAFSDDADGMTLAEGVGVVLVERLSDAQRNGHPVLAVLRGSAINQDGASNGLTAPNGPSQQRVIRQALANARLAPGDIDALEAHGTGTPLGDPIEAQALFATYGRDRDPESALLLGSVKSNIGHTQSAAGIASVIKMVMALRHSELPPTLHADAPSSHVDWSAGTVRLLTQARAWPETGRPRRAAVSSFGISGTNAHVLLEQAPVADTPAEERPAVAPVPIAAGVVPWVVTARSAAALRGQAERLLAHAETVGTALPAAGPLDIGLSLVSARARFEHRAVVVPPAGTDPLAALRAVATDGPSPVVARGVADVEGRTVFVFPGQGSQWVGMGSQLLDESAVFAERIAECAAALAEFTDWSLVDVLRGVVGAPSLERVDVVQPASFAVMVSLAALWRSRGVLPDAVVGHSQGEIAAAVVSGALSLRDGARVVALRSQAIGRALAGRGGMMSVALSVDVLEPRLVEFEGRVSVAAVNGPRSVVVAGEPEALDALHARLTADDIRARRIAVDYASHSHQVEDLHEELLEVLAELAPRTSEVPFFSTVTGDWLDTARMDAGYWFRNLRGRVRFADAVADLLAAEYRAFVEVSSHPVLSMAVQEAIDEAGVPAVAAGTLRRDQGGTDRFLLSAAEVFVRGVDVDWAGLFEGTGASRIDLPTYAFQHEHLWAVPPAPEAVAAADPDDAAFWTAVEDGDVSALTAALGTDEDSVAAVLPALTSWRRARRDRSTVDAWRYRVAWKPLGGTLPHPSLTGTWLLVTADGIDDTDVAGALETYGAEVRRLVLDEECVDRAVLRERLAGAEDVTGIVSVLAAAERTDAVPGTSLVLGTALTVALIQALGDAEIDAPVWALTRGAVSTGRADELTAPVQAQVTGIGWTAALEHPQRWGGTLDLPAALDARAAQRLAAVLSGALGSDDQLAIRPSGVFTRRIVRAEATAGRPAGTWTPRGTTLVTGGSGTLAPHLARWLAQRGAEHLVLISRRGTAAPGAAELVAELAESGTEATVAACDITDRDAVAALLADLKADGRTVRTVVHTAATIELHTLDATTLADFDRVLHAKVTGAQVLAELLDDEELDDFVLYSSTAGMWGSGAHAAYVAGNAYLAALAEHRRANGLPALSLSWGIWADDLKLGRVDPQMIRRSGLEFMDPQLALSGLQRALDDNENVLAVADVDWETYHPVYTSGRPTPLFDEVPEVRRLTAAAEQSAGTVAEGEFAAALRALSDAEQQRTLLETVRTEAASVLGLSSAEDLTDQRAFRDVGFDSLTAVGLRNRLASVTGLTLPSTMVFDYPNPAALAAYLHGELAGARSAAAGAAAVPTGAPDADDPIAIVGMSCRYPGGVGSAEDLWRIALDEVDAISGFPADRGWDAEGLYDPDPDRPGRTYSVQGGFLRDVAEFDPGFFGISPREALSMDPQQRLLLETAWEAFEHAGIDPVGQRGSRTGTFVGASYQDYASGVPNSEGSEGHMITGTLSSVLSGRVSYLFGFEGPAVTLDTACSSSLVAMHLACQSLRNGESSLALAGGVSIMSTPMSFVGFSRQRALAEDGRCKAYADGADGMTLAEGVGLVLLERLSDARANGHQVLAVIRGSAVNQDGASNGLTAPNGPSQQRVIRQALANSAVAPGDIDVLEGHGTGTALGDPIEAQALLATYGQDRAPERPLLLGSVKSNIGHTQMASGVASVIKLVRALQEGVVPKSLHIDRPSTHVDWSSGAIGLLTERTPWPETGRPRRAAVSSFGISGTNVHTILEQAPADEAPTPADPPRDGLVPVLLSGRGEAALRAQAARLLAFVEERPEAHLTDLAHSLATSRAALERRAAVIAADRDTLTRGLRALSDGRPDPGLVQGTAGRGRTAFLFTGQGSQRPGMGRELHDRYPVFADALDEVLARLDDGPDRPLREVLFAAPDSAEAALLDRTGYAQPALFAVEVALFRLLTSWGLTPDYLAGHSVGELAAAHVAGVLSLDDACTLVAARGRLMQALPEGGAMVALEAAEDEVLPLLEGLTDRVSVAAVNGPRSVVVAGVEEDVLLLADLFAADGRRTKRLRVSHAFHSPLMDAMLDDFAAVARGLTYHPPTIPFVSNVSGGLATAEQVRTPDYWVGHVRAAVRFADGIDWLATQGDVHTFLELGPDGVLSAMARESLTDPSRTALLPTLRGDRPEEPALVTAVAAAHAHGARVDWSGYFADHGARRTTLPTYAFQRERYWPDTTAATSAHTPGSALDAEFWAAVERDDVAALAASLDLDDATVTAMVPALTAWRRRRGEQTELDSWRYRVTWKPRGGATAPAALTGRWLVLVPHDHQDRQDDATAAWAADVETALGTTTVRLTVTTTDRAALAARITEAAGDQGPFSGVLSLLPLATGDAGHPGAPAALTLTTTAVQALGDAGIDAPLWNVTRGAVAVGRAEQVTAPEQAAVWGLGRAVALELPARFGGTLDLPATLDGQAARRLRAVLAATDGEDAVALRPSGVFLRRLAHAPAGPDTARTAFDPAAGTVLITGGTGGIGGHVARRLARDGATHLLLTSRRGPAAPGADALRAELEELGARVTLAACDAADRDALAALLAELPDDAPLCAVFHTAGVVEDHVVDALTPENFAAVLRAKTVAAHHLHELTADLDLAAFVLFSSTAGVLGAAGQGNYAAANAHLDALAEHRRSHGLTALSVAWGPWAGSGMVADAAELTDRVRRGGFEPLAPEPAVRALLRAIENDDTTVALADIDWERFQRAFAAVRPLPFVADLPETGRATPATATGAATGLRQQLAELPEHERPAAVLDLLRTQVAAVLGHADPRTVEDDHAFRDLGFDSLTILELRNALNAATGLSLPATLVYDLPTPREMADFLLAELLGTLPTDTAATVASTASPKLSASFEQGGTPFDDPIAVIGIGCRFPGGVTTPEELWQLLDEGRDGISRFPDDRGWDLAALGAGASDTLEGGFLTGVADFDARFFGISPREALAMDPQQRLLLETTWEALERAGIDPTTLRGSTTGVFVGTNGQDYPTLLRRSASDVAGYVATGNTASVMSGRLSYALGLEGPAVTIDTACSSSLVALHWAGRALRAGECDLVVAGGVSVMASPDSFVEFSTQGGLAPDGRCKAFSDAADGTAWSEGVGILVLERLSAARRNGHQVLGLIRGTAVNQDGASNGLTAPNGLSQQRVIAQALADARLRPADIDAIEAHGTGTTLGDPIEARALITAYGRDRDAERPLLLGTVKSNIGHTQAAAGAAGVIKMLMAMRHGTLPRTLHVGTPSSHVDWSGGTVALLDDARPWPRTGQPRRAGVSAFGVSGTNAHVVVEQAPETEAPAAPAAEPAPEATPTVVPWVVSGRSREALQAQLDRLTAHTAAHPARSAADVGRSLATDRTLFPHRAVLLAGPDGVREAARAAAPRTPGRTAFLFSGQGAQHALMGHDLYQRFPVYADALDTVLAQFDTVLDVPLRAALFAAPGTPEAALLDQTGFTQPALFAVEVALFRLAESWRLTPDFVAGHSIGEIAAAHVAGVFSLEDACTLVAARASLMQQLPRDGAMVALEATEDEVAPLLTDGVALAAVNGPRSVVVAGAEDAVRAVADRLAADGRRTRRLTVSHAFHSPLMDPMLTDFARVAEGLTYHEPRIPLVSTLLGAPAGAELRTPDYWVRHVRETVRFADGVRALHDAGAGTFVEIGPDGVLTALTQQTLDTVEAGAPAVVVPLQRRDRAGDLALLEGLATLHTHGTGPSWPAYFEATGGHRTDLPTYAFQRERYWPELGAPVATAPQDPAAWRYHETWAPLPAPEAAAPAGRALVLVPAGNRDTAWMTAVADALGADTVTAEPDALAEQLTAAGDTPWRVVVSLLAAASEGLPADGAWPAALLATLDEAGVHAPLWCVTRGAVAVAGEAPTAVGQAALWGLGRVAALDHPDRFGGLADLPADTDAHAAGLLAAHLAAPGTEAEIAVRATGVHARRLVRTPAAADGATWLPTGTVLVVGGTGGTGTMGGRAARWLVREGARHLVLTAPDGTTTAADTEALTAELAALGARITVVDHDPTAPDGFAALLDGLPDDTPLTAVVYAPEADAAPGTAAELSAALAPVTALGAALTGRPLDAFVLFGSIAGLWGVRGRAAEAASGAYLDAFARACRDRGTPALAVAWGAWADLVGPSLAAHLRMNGLPVMDADTALTALSRAVADGSAAEAVADVRWETFAPLHHEARRTALFDALPEARGALAEAARDRADRKTAAGDYGRWLAEQPAADHDAILLALVTEKAATVLGHADHDLLEPDLPFRDLGFDSLTAVDLRNQLTAETGLTLPATLVFDHPNPAALAAHLRAQLLGEASDSAAPVAAPVALGADDDAIVIVGMACRYPGGVTSPEDLWQLVGDEVDAVGDFPTDRGWDLAALAGDGPGRSATAQGGFLYDATDFDPGLFGISPREALVMDPQQRILLETSWEALERAGIDPATLRGSGTTGVFVGGGSGDYRPPEEAGQWQTAQSASLLSGRLAYTFGIQGPTVSVDTACSSSLVALHLAAQALRAGECSIALAGGVTVMATPVGFVEFSAQGALSPDGRCRAFSDDANGTGWSEGVGMLVVERLSDARRNGHRVLAVLRGSAINQDGASNGLTAPSGPAQQRVIRQALANARLRPADIDAVEAHGTGTRLGDPIEAQALLATYGQDRERPVLLGSLKSNIGHTQAASGVGGVIKMVLAMQHGELPRSLYAENPSSHVDWTAGRAHLLTARTPWPDSGRPRRAAVSSFGASGTNAHAILEQPPREELPARPADDGAPLPFLLSGRSQNALRAQARRLLARLTAHPDTRAADLAYSLATTRAAFEHRAAITATDHDGLRTGLTAVAEGTTAPHTAEHHLQGTGKRAVLFSGQGSQRLGMGRELHERHPVFAEAFDSVLARLDDRLDTPLRDVVWGTDEEALHATGNTQPALFAVEVALYRLIESWGVRPDFVAGHSVGELAAAHVAGVLSLDDACRLVAARAALMQRLPAGGAMIAVEATEDEVTPLLTDGVSLAAVNGPTAVVLSGAGDAVTALGQALAERGHRTTRLRVSHAFHSHLMDPMLADFRTVAEGLEYHPPRIPVVSNLTGDVADAADLCSADYWVRHVRGTVRFADGVRTMADRGVHLFLELGPDAVLSAMARQCAPDAVVVPALRRNRDEDETLVGAVARLHVHGAGPRWDAYFAGRGAQWLDLPTYPFQRGRFWPESLPGAASAAPAAGQPAETDAAFWDAVAQEDFTALESVLDVESDALSKVLPALMDWRSRQADESQLAGWRHRIVWKRLTGAALAHRKALSGTWLAVVPEGFADDPWVTTTLDGLGTHLVHLEVAEADRAALADAIAARTADGTRFGGVISLLALREELTGAVPEGTALTTTLLQALGDAGVDAPLWCVTRSAVSAGRTDRPHRPLQGAVWGLGRVAALEYPQRWGGLVDLPEEPDERSAAGLAAVLAGLDGEDQVAVRGTAVLARRLVPAPGRKPSRPWHPSGTVLVTGGTGALGAHVARRLAKDGAQHLVLLSRRGPDAPGAAELRAELDALGTDVTVAACDVADRDQLTAVLDALPADRPLTGVVHTAGVLDDGVLDRLTPERFQEVFRAKVTSALLLDELTRDRELAAFVLFSSASAAVGNPGQANYAAANAVLDALAEQRRVLGLPATSVSWGAWGGGGMADADGADEAARRAGVGAMDPHLAVEALLRLVAEKEPTAVVAEVALDRFAGAFGGSRPSALLREFPGYREALAAQAEQAADGGGLAARLAALPPARRLDTVVDLVRTRAAQVLGYPDTEAVAAERSFRDLGVDSLGAVELRNQLSAATGLNLPATLVFDHPTPLVLGEHILGGLFPDEPAGSDDETEIRALLASVPLDQLREIGVLEPLLQLAGRGGRAADGDDGESVDSMTVADLVRAALNGQSDL

SEQ ID NO: 38 - protein, 5435 aa, Streptomyces noursei
MNAPENPETPENNVVAALRAAVKETDRLRRQNRMLVAAAKEPIAVVGMACRFPGAVDSPEALWEMVATGTDVISGFPDDRGWDLEALRNSGTDARDTDVSQRGGFLDCIADFDPGFFGISPREAVTMDPQQRLLLTTAWEAVERAGIDATTLRATRTGAFIGTNGQDYAYLLVRSLDDATGDVGTGIAASAASGRLSYTLGLEGPALTVDTACSSSLVALHLAVQALRNGECGMALAGGVNVMATPGSLVEFSRQGGLARDGRCKAFADAADGTGWSEGAGVLLLERLSDAQRNGHPVLAVVRGSAVNQDGASNGFTAPNGPSQQRVIRQALANAGLATGDIDAVEAHGTGTPLGDPIEAQSILATYGQDRAHPVLLGSIKSNMGHTQAASGVAGVIKMIMAMRHGVLPRTLHVDRPSTHVDWTTGSVELLTDAHPWPETGRPRRTGISSFGVSGTNAHVIVEQAPDTPAEAADDTPPRTPRTLPWLLSARTGAALRDQATALLDHLDRPDGDRGPTALDTAFSLATTRAALEHRLAVVTGTDGTAGRDALTAWLAHGTAPDAHEGHAAGRTRCAALFSGQGAQRLGMGRELHARFPVFARALDTAVDLLDAELGGTLREVIWGTDDAPLNETGFTQPALFAVEVALYRLIESWGVAPDFVAGHSIGEIAAAHVAGVFSLEDACTLVAARAGLMQALPRGGAMVAVEATEDEVSPLLTDGVAIAAINGPTSLVVSGDETATLAVAARLAEQGRRTTRLRVSHAFHSPLMDPMLAEFRAVAEGLSYGEPQIPVVSNLTGAVADGTLLGTADYWVRHVREAVRFADGIRALTDAGVGAFLELGPDGTLAALAQQSAPDAVSVPVLRKDRDEEPAAVAALARLHTAGVPVDWTAFYAGTGAHRTDLPTYAFQYERYWPKATYRPADATGLGLTAADHPLLGAAMSVAGSDELLLTGTLSLATHPWLADHVVGGMVFFPGTGFLELAVRAADQVGCDRVEELMLAAPLILPATGTVQMQIAVGAADDDGGRDLRFFTRPGDDPDAAWAQHATGRITEGERVLALDTTTWPPRDAEPVDIDGLYDRYRANGLDYGPVFRGLRAVWRRDTEIYAEVALPEGTADADAFGLHPALFDAVLHSTLFASADGDDRSLLPFAWNGVSLHAAGADALRVRITSCGPDAVEITAVDPQGRPVVSVESLTLRAAGPDAGTADHRADAGSLFRMDWTPRTVHAPATPATWAVLGTDPIGLTEALTAAGPDTVTGLRDGVDALGELTAGDDRPVPDVVAVPLRGATDHGPAGAHDLTRTVLALLQEWLAEERFARSRLLLVTRGAVADGERGPLDLAAAPVWGLVRSAQSENPGRLLLVDLDDTAESAAQLPLLPALLDADEPQAVVREGTVRVGRLARLDSGRGLVPPPGTPWRLGSRAKGSLDGLALLPHPEARRPLTGHEVRVGIRAAGLNFRDVLNALGMYPGDAGLFGSEAAGVVVEVGPEVTGLAPGDRVMGMLFGGFGPLGIADARLLTPVPADWSWETGASVPLVFLTAYYALKELGGLRAGEKVLVHAGAGGVGMAAIQIARHVGAEVFATASEGKWDVLRSLGVADDHIASSRTLDFEAAFAEVAGDRGLDVVLNALSGEFVDASMRLLGDGGRFLEMGKTDIRAADSVPDGLSYHSFDLGMVDPEHIQRMLLDLVELFDRGALAALPVRSWDVRRAGEAFRFMSLAQHIGKIVLTVPQPLDPDGTVLLTGGTGGLAGLLARHLVTEHGARHLLLAGRRGPDAPGAAALHAELTALGAEVTVAACDVADRTALAALLATVPAEHPLTAVVHTAGVLDDGTLTALNPDRLATVLRPKVDAAWHLHDLTRHLDLAAFVLYSSTAGVMGGPGQANYAAGNTFLDALAAHRHALGLPATSLAWGAWEQGAGMTGALTDHDLRRVSDAGGQPLLTAERGLALYDAATAADEPLIVPLGLTGGALPAGVGVPAVLRGLVRTAGRRARAGTAGVSRAGLAERLAALPEEERTPFLVELVRTEAATVLGHGSTDPVDARREFRQLGFDSLTAIELRNRLGKATGLTLPATLIFDYPTPDRLAVHLHDELLGADAPVTVTAAAQAADPEHDPVVIVGMSCRFPGGVSSPEELWDLVASGTDAITGFPADRAWDRHPQLAGAPGARTGQGGFLRDIADFDAAFFGISPREALAMDPQQRILLEVAWEAAERAGIDPQTLRGSDTGVFMGVSGQDYAGLVMRSRDDIAGHATTGLAVSVVSGRLAYALGLEGPALSVDTACSSSLVSLHLAAQALRAGECTMALAGGVTVMTTAANFTGFSRMGGLAQDGRCKAFSDSADGTGWSEGAAVLVLERLSDARRAGHRVLAVVRGSAVNQDGASNGLTAPNGPAQQRVIRQALANAGLTPVDVDAVEAHGTGTPLGDPIEAQALIAAYGTDRDPEHPLLLGSVKSNIGHTQSAAGAAGLVKMVMAMRHGILPQTLHLTEPSSHVDWSAGTVRLLTERTAWPRTDRPRRAGVSSFGISGTNAHVILEQPPAEPTPAADPGRPAPTVVAWPVSAQTPAALDAQLDRLRTAAALAPLDTAHTLATGRSLFEHRAVLLATVGDPATGAPDLPEVARGAATPHRTAFLFSGQGAQRSGMGRELHAAFPVFAAAFDEVVAVLDAELGSDADGGVSLREVMWGGGSELLDRTRFTQPALFAVEVALFRLVASWGVGPEFVAGHSVGEIAAAHVAGVFSLVDACRLVVARASLMDALPVGGVMVAVEAAEAEVVPLLVDGVAIAAVNGPVSVVVSGVEAAVGQVVDQLVERGRRVRRLAVSHAFHSPLMDPMLDAFRAVAEGLEYHQPRIPVVSNVTGEVAAAEELCAADYWVRHVRATVRFADGVRTLAERGATAFLEIGPDGVLSALARGVLPAEALVTPTLRKDRDEESALLAGLARLHVAGVTVDWSAALTGTGARGTDLPTYAFQRERYWPELAAEPAGGGADAADAEFWAAVERADATALAAHLDIDGDQLGAVLPALSAWRTRRRTTSATNALRHRESWEPLSLAGTPHTGGVLVLVPAAATTDPWVADVVAALGPDARRVDVPADGTDRAALAALLTEAADDTAPTAVVSLLALDETSGDDAVPAGTTATAALVQALADTGAPAPLWALTRGAVAALPDEQPTAPAQAAVWGLGRIAALELPRHWGGLVDLPADLDERTARRLPAALADAGDEDQLALRATGAYGRRITPAPAPDDAPGTGWQPTGTVLITGGTGALGRHTARWLAAHGAEHLLLLSRSGPDAPGAAELTTELTALGARVTLVACDAADREQLTRVLAEVPRDCPLTGVVHTAGVLDDGVLTGLTPDRFATVFRAKVASAVLLDELTRDTDLAVFALFSSVAGAVGNPGQAGYAAANAVLDALAARRRAQGLAGTSIAWGAWAGDGMAARHTRPGAEPVGLLDPDLAVPALARAVTEPQPTLVLADLQQPRLLESLLALRPSPLLSRLPAARTAARAVQEADRRRAGAAADLRDQLAGTAPADRHAVLLRLVRTTAAAVLGHTGADAIRADKPFRDLGFDSLTAVELSSALAAATGLALPPSLVFDHPSPRALADHLRAELTGDRPESAPAAPPAPVPAADDDPIVVVGMACRFPGGVTTPEEFWQLLAEGRDGIDAFPTDRGWDLDVLGRRRPGPQRPPRSAASSYDAAAFDPGFFDISPREALAMDPQQRLLLETAWEAVERTGTDPTRLRGSRTGVFVGTNGQDYAGLVLRAQEDVEGHAGTGLAASVISGRLAYAFGFEGPAVTVDTACSSSLVALHWAVQALRAGECSLALAGGVTVMTTSTSFAGFTRQGGLAPDGHCKAFSDSADGTGWSEGVGVLVVERRSDALRNGHEILAVVRGSAVNQDGASNGLTAPNGPAQQRVIRQALANAGLAPGDVDAVEAHGTGTVLGDPIEAQALLATYGQDRPADRPLWLGSVKSNIGHTQAAAGAAGLMKMVLALQHGTLPRTLHVTEPSTRVDWSAGAVRLLTERTVWPRTDRPRRAGVSSFGISGTNAHVILEQPPAEPTPTAPADRPTRTPAVLPWVVSARSATALDAQLARLRAFAAERPDLPPADVAHSLVTSRATFEHRAVLLAAPDGITAAARAEARERSTAFLFSGQGAQRSGMGRELHAAFPVFAAAFDEVVAVLDAELATGSGGGVSLREVMWGGGSELLDRTRFTQPALFAVEVALFRLVASWGVGPEFVAGHSVGEIAAAYVAGVFSLVDACRLVVARASLMDALPVGGVMVAVEAAEAEVVPLLVDGVAIAAVNGPVSVVVSGVEAAVGQVVDQLVERGRRVRRLAVSHAFHSPLMDPMLDAFRAVAEGLEYHQPRIPVVSNVTGEVAAAEELCAADYWVRHVRATVRFADGVRTLAERGATAFLEIGPDGVLSALAAACLFDTDAEVVPALRKGRPEEHTALTAAAQLHVAGVDIDWTAVLAGTGGRRIALPTYAFQRERYWPSLAAQAPGDAGGLGLEAGRHPLLGAATTVAGSAEILLTGRLSTTAQPWLAVYEADGRTVLPAAVLAELAVRAGDQADCPTVAELTVAAPLVLTGAAAQRLQVRVAAPDDTGRRALSVHARPDDSPDSPWTLHATAVLTHDTPQPPAPDTGWPPERAVPLDALPTATGPARIAAAWQWGDELCAEIELPEPGPAERAFALHPALLDTAVRAGGLLDGDATLDALGWRGLALHAASATALRVRLTPDGTDTWALEATDPQGAPVVSVTGLTLGTPTVDRSGAGAADDGATLLDLEWVPAPQAAPTGGDHLPYAVLGDQLAELDGQLRIAGDGPGRVASLAALLDGGAPLPRLVLAPVLGVPTGEGDLPAAVRGTTTAVLELLQRWTADARTADSHLVIVTRGAVAAGAEDVHDLAAAPVWGLVRSAQSEHPGSFLLLDLDPADPAGASRAAAPATLAALLDAGETQAAVRADTLTVARLTRAADGPEATAGHPVRDWDRDGTVLITGGTGGLGGLLARHLVTGHGIKHLLLAGRRGPDAPGARALRDELAALGAEVTVAACDVADRAALDRLLAQLPPEHPLTAVVHTAGVLDDATVGTLTPERLDTVLRAKADAAWHLHDATRDRDLAGFVLYSSVAGVTGGPGQGNYAAGNTFLDALAAHRAAQGLPGLSLAWGPWGQDAGMTGTLGAADLARLERSGMPPLTPEQGLALFDAAGARGDGFAVAVRLARGAAAPGADEVPAVLRALVRGRRRTAAAAGHAGVLARRLAALDAEQRHQALLDLVRTETAAVLGHSGADAVPAERDFNRLGFDSLMAVELRTRLATATGARLPATLVFDHPTPDAVARHLASTLPGGTAAGPDRSPLAELDRIAAELSPEGADDATRQGVVGRLRHLLAQWDGTRQDGGGTTVDDRIEAASAEEVLAFIDHELGRQADS

SEQ ID NO: 39 - protein, 2066 aa, Streptomyces noursei
MPDEKKLVDYLKWVTKDLHQTRQRLQEVEAGRHEPVAIVGMACRFPGGVRSPEDLWELLSAGRDGIGPFPADRGWDLAALAGDGPGRSATQEGGFLPDAAAFDPGFFDISPREALAMDPQQRLLLETAWEAVERSGIDPAGLRGSRTGVFVGTNGQDYAHLVLAAQDDMGGYAGNGLAASVLSGRLAFALGLEGPAVTLDTACSSSLVTLHLAAQAVRAGECGLALAGGVTVMTTSSSFAGFSLQGGLAPDGRCKAFAEAADGTGWSEGIGLLLVERLSDAQRNGHPVLAVLRGSAVNQDGASNGLSAPNGPSQQRVIRQALAGAGLVPGDVDAVEAHGTGTRLGDPIEAGALLATYGQDRPADRPLWLGSVKSNLGHTQAAAGVAGVIKMVLALRHGVLPQTLHVDAPSSHVDWESGAVRLLTAPVAWSEGDDRVRRAGVSSFGISGTNAHVILEQAPDQPEPTAEETAAAAPGGTAEERAAAPVAPRAVPWPVAARTAGALDAQLVRVRALTTAPGRTAADVGHALATARTPFEHRALLVHEGGAVTEVARGAVPTGDRGGLAVLFSGQGSQRPGMGRELHARYPVFAAAFDETVALLDARLGTSLRDIVWDQDRTRLDDTRHTQPALFAVEVALYRLLASWGIRPDHVTGHSIGEITAAHVAGVLTLADACTLVAARATAMSELPPGGAMVALEATEDEVRPLLTDDLAIAAVNAPRSVVVAGAEDAALAVRRHFDDLGRRTTRLPVSHAFHSPLMDPMLDAFRTALAPLTFAEPEIPVVSNLTGLPATAEELATPHYWVCHVRQAVRFGDGVRALADRGVRTFLELGPDGVLSALVRENLPEPGLVAVPVLRKERPEETTVLAALGTLWAHGADVDWDAVFAGTRTPQADPVELPTYAFQRARYWPTLGARHGDPADLGQTAAAHPLLGAAVTLADADETVLTGRLALPSHPWLGDHRSDGRITVPGVAFAELAVRAGDLSGTPHLARLDLPAPLTLGDGDTVTLQVRVGAPDPAGHRPLTVHARLAATEDAPWTTCATGLLAPDAPEAPADPIGPADAGWPPRDARPVPVADLDAAATAAGRHYGPHFQGLTGLWRRDGEVFAEVALPTATAADRAFGIHPALLATALRATAALDDDHTAGHTPEPTGITGLALHATGATALRVRLTATGPDTVALAAADATGGAVLTADTVTLGSPQDRPAPAPAGHTGQGGLFHLDWVPVDPGSRATGTRWAVVGDDELDLGYALHRADETVSAYAASLGGAIGDSGLAPDVFLVPVVGGPDAGPDAVHAVTARALGLLQEWLNEPRLAGARLVFVTRGAVAVPGETVTDPAGAAVWGLLRSAQTENPGSLLLVDLDDAFRSAGMLPHVLTLDEQQLVVRDHAVRAARLARLPEPAAGTAPARAWDPDGTVLITGGTGGLGAALARHLVTVRGARHLLLAGRRGPEAPGAGELVAELTAQGADVRVAACDVGDRTALDALLATVPAAHPLTAVVHTAGVLDDALIGSLTPDQLATVLRPKADAAWHLHDATRGLDLAGFVLYSSVSGVLGSPGQGNYAAANAYLDALARHRADQGLPALSLAWGPWGRGSGMTASVSDADLERMARGGLPPLTVEDGLALFDAAVGRPEPALVPSRINVAGLRDQQALPALWRDLVPRARRTAATADRSPVTVRERLRHLDETGQEQLLIDLVVGYTAGLLGHPDPTAVDPERGFLELGFDSLVSVGLRNQLAEILGLRLPSSIVFDSKSPVKLARWLHQELANGPQPGATGPAAADARPAVRSDDTLEGLFYNAVRGGKLVEAMRMLKAVANTRPMFDTPAELEELSEPVTLADGPGRPRLIFVSAPGATGGVHQYARIAAHFRGSRHVSALPLMGFAPGELLPATSEAAARIVAESVLMASEGEPFVMVGHSTGGSLAYLAAGVLEDTWDVRPEAVVLLDTASIRYNPGEGNDLDRTTRFYLADIDSPSVTLNSARMSAMAHWFMAMTDIQAPAPTAPTLLVRAARALDGFRLDTSSVPADEVRDIDADHLSLAKEHSALTAQAIEGWLAELPDPAA

SEQ ID NO: 40 - protein, 394 aa, Streptomyces noursei
MSTPTAPPSLKAEVPPVLRLSPLLRELQSRAPVCKVRTPAGDEGWLVTRHTELKQLLHDDRLARAHADPANAPRYVHNPFLDLLVVDDFDLARTLHAEMRSLFTPQFSARRVMDLTPRVEALAEGVLAHFVAQGPPADLHNDFSLPFSLSVLCALIGVPAEEQGKLIAALTKLGELDDPARVQEGQDELFGLLSGLARRKRITPEDDVISRLCLKVPSDERIGPIASGLLFAGLDSVASHIDLGTVLFIQHPDQLAAALADEKLMRGAVEEILRSAKAGGSVLPRYATADVPIGDVTIRAGDLVLLDFTLVNFDRTVFDEPELFDIRRAPNPHLTFGHGMWHCIGAPLARVNLRTAYTLLFTRLPGLRLVRPVEELRVLSGQLSAGLTELPVTW

SEQ ID NO: 41 - protein, 64 aa, Streptomyces noursei
  MISC_FEATURE (1)..(1): Xaa is Val or Met
XRITVDPGRCVGAGQCVLTAPDLFDQDDDGLVTVLAGAADAADPGDVRDAAALCPSGAISVAAD

SEQ ID NO: 42 - protein, 398 aa, Streptomyces noursei
MSTEADARTAAPQCPVAFPLRRPGRPFPPPEYATYRGGAGLVRSELPSGPVWLVTRHEDVRAVLTDPRISADPSKPGFPKAGRTGGAPSQYEVPGWFVAMDPPEHGRFRKTLIPEFTVRKVRELRPVIQQIVDERIDAMLAAGTSADLVESFALPVPSLVISSLLGVPKVDRDFFEDRTRVLVRLSSTDEERDKATQALLRYLGRLIQIKQRRPGDDLISRLIAAGTLSRQELSGVAMLLLIAGHETTANNIGLGVVQLLTNPRWIGDDRIVEELLRYYSVADLVAFRVAVEDVEIGGQLIRAGEGIVPLIAAANHDATAFAAPSEFDPERSARSHVAFGYGVHQCLGQNLVREEMDIAYRTLFARIPSLTLAVPVEELPLKYDGVLFGLHELPVTWK

SEQ ID NO: 43 - protein, 226 aa, Streptomyces noursei
  MISC_FEATURE (1)..(1): Xaa is Val or Met
XTITHLTDSNHRTTGGVISAQTAPAGESVGPGLMASLDRDLTIKHANQEFRRRFDDSAGDVCGRSFRDLMHPSVQQPLMRQFSRLIEGKRHRFASHVVAVGAQDAAFAGTLTASAVTGKTPDIAGILVLMDSSGAADAADAGVVTSQKKFLTEIDARILEGIAAGLSTIPLASRLYLSRQGVEYHVTGLLRKLRVPNRAALVSRAYSMGILNVGTWPPKVVDDFIK

SEQ ID NO: 44 - DNA, 29 bp, Artificial
  Oligonucleotide Primer
gccggcatgcgacgaacaggacgagaggt

SEQ ID NO: 45 - DNA, 18 bp, Artificial
  Oligonucleotide Primer
gccgtggtcgacgaaggc

SEQ ID NO: 46 - DNA, 24 bp, Artificial
  Oligonucleotide Primer
ctcagcatgccgaaaggatggcgg

SEQ ID NO: 47 - DNA, 25 bp, Artificial
  Oligonucleotide Primer
aggcaagcttcggcgacacgggcgt

SEQ ID NO: 48 - DNA, 24 bp, Artificial
  Oligonucleotide Primer
ctcagcatgcgtacgaccggcggg

SEQ ID NO: 49 - DNA, 10 bp, Artificial
  Oligonucleotide Primer
cgccgcatgc

The invention claimed is:

1. A method for preparing a nucleic acid molecule encoding a modified nystatin polyketide synthase (PKS), said method comprising: performing a recombinant DNA modification to the nucleic acid of SEQ ID NO:35 to prepare a nucleic acid encoding a modified nystatin PKS by introduction, mutation, deletion, replacement or inactivation of one or more PKS activities compared to the nystatin PKS encoded by the nucleic acid molecule of SEQ ID NO: 35, wherein the encoded modified nystatin PKS synthesizes a polyketide other than the polyketide synthesized from a native nystatin PKS.

2. The method of claim 1, wherein said nucleic acid molecule is modified such that a PKS activity selected from the group consisting of ketosynthase (KS), acyltransferase (AT), ketoreductase (KR), dehydratase (DH) or enoylreductase (ER) in said encoded modified nystatin PKS is inactivated, deleted or replaced by a version of that activity from a different PKS or from another location within the same PKS.

3. The method of claim 2, wherein said nucleic acid molecule is modified such that a KS activity in said encoded modified nystatin PKS is inactivated, deleted or replaced by a version of a KS activity from a different PKS or from another location within the same PKS.

4. The method of claim 2, wherein said nucleic acid molecule is modified such that an AT activity in said encoded modified nystatin PKS is inactivated, deleted or replaced by a version of an AT activity from a different PKS or from another location within the same PKS.

5. The method of claim 2, wherein said nucleic acid molecule is modified such that a KR activity in said encoded modified nystatin PKS is inactivated, deleted or replaced by a version of a KR activity from a different PKS or from another location within the same PKS.

6. The method of claim 2, wherein said nucleic acid molecule is modified such that a DH activity in said encoded modified nystatin PKS is inactivated, deleted or replaced by a version of a DH activity from a different PKS or from another location within the same PKS.

7. The method of claim 2, wherein said nucleic acid molecule is modified such that an ER activity in said encoded modified nystatin PKS is inactivated, deleted or replaced by a version of an ER activity from a different PKS or from another location within the same PKS.

8. The method of claim 1, wherein said nucleic acid molecule is modified such that at least one noncondensation cycle enzymatic activity selected from the group consisting of KR, DH and ER is deleted or mutated in said encoded modified nystatin PKS.

9. The method of claim 2, wherein said nucleic acid molecule is modified such that the ER domain of module 5 of NysC (amino acids 4953 to 5239 of SEQ ID NO: 7) is inactivated in said encoded modified nystatin PKS.

10. The method of claim 1, which comprises introducing a sequence encoding an ER domain.

11. The method of claim 10, wherein the sequence encoding an ER domain is inserted into the sequence encoding module 3 of NysC (amino acids 35 to 1735 of SEQ ID NO:7), or the sequence encoding module 4 of NysC (amino acids 1757 to 3480 of SEQ ID NO:7).

12. The method of claim 10, wherein said nucleic acid molecule is modified such that the ER domain in module 5 of NysC (amino acids 4953-5239 of SEQ ID NO:7) is inactivated in said encoded modified nystatin PKS, and the sequence encoding an ER domain is inserted into the sequence encoding a module selected from:
(i) module 3 of NysC (amino acids 35 to 1735 of SEQ ID NO: 7),
(ii) module 4 of NysC (amino acids 1757 to 3480 of SEQ ID NO: 7),
(iii) module 7 of NysC (amino acids 7408 to 9193 of SEQ ID NO: 7),
(iv) module 8 of NysC (amino acids 9214 to 11012 of SEQ ID NO: 7),
(v) module 9 of NysI (amino acids 34 to 1793 of SEQ ID NO: 37 or 20),
(vi) module 8 of NysC (amino acids 9214 to 11012 of SEQ ID NO: 7) and module 9 of NysI (amino acids 34 to 1793 of SEQ ID NO: 37 or 20), or
(vii) modules 7 and 8 of NysC (amino acids 7408 to 9193 and amino acids 9214 to 11012 of SEQ ID NO: 7);
in said encoded modified nystatin PKS.

13. The method of claim 1, wherein said nucleic acid molecule is modified such that a sequence encoding a methylmalonyl-specific AT domain in module 11 (amino acids 3898 to 4217 of SEQ ID NO: 37 or 20) is replaced with a sequence encoding a malonyl-specific AT domain.

14. The method of claim 1, wherein said nucleic acid molecule is modified such that a sequence encoding a malonyl-specific AT domain in module 12 (amino acids 5432 to 5474 of SEQ ID NO: 37 or 20) is replaced with a sequence encoding a methylmalonyl-specific AT domain, and the sequence encoding a methylmalonyl-specific AT domain in module 11 (amino acids 3898 to 4217 of SEQ ID NO: 37 or 20) is replaced with a sequence encoding a malonyl-specific AT domain.

15. The method of claim 1, wherein said nucleic acid molecule is modified such that a sequence encoding a malonyl-specific AT domain in module 10 (amino acids 2346 to 2664 of SEQ ID NO: 37 or 20) is replaced with a sequence encoding a methylmalonyl-specific AT domain, and a sequence encoding a methylmalonyl-specific AT domain in module 11 (amino acids 3898 to 4217 of SEQ ID NO: 37 or 20) is replaced with a sequence encoding a malonyl-specific AT domain.

16. The method of claim 1, wherein said nucleic acid molecule is modified such that a P450 monooxygenase NysL (SEQ ID NO: 40) or NysN (SEQ ID NO: 42) is inactivated in said encoded modified nystatin PKS.

17. The method of claim 1, wherein said nucleic acid molecule is modified such that a DH domain in module 3 (amino acids 872 to 1073 of SEQ ID NO: 7) is inactivated in said encoded modified nystatin PKS.

18. The method of claim 1, wherein said nucleic acid molecule is modified such that a DH domain in module 4 (amino acids 2617 to 2818 of SEQ ID NO: 7) is inactivated in said encoded modified nystatin PKS.

19. The method of claim 1, wherein said nucleic acid molecule is modified such that a DH domain in module 3 (amino acids 872 to 1073 of SEQ ID NO: 7) and an ER domain in module 5 of NysC (amino acids 4953 to 5239 of SEQ ID NO: 7) are inactivated in said encoded modified nystatin PKS.

20. The method of claim 1, wherein said nucleic acid molecule is modified such that an ER domain in module 5 of NysC (amino acids 4953 to 5239 of SEQ ID NO: 7) and a DH domain selected from:
(i) DH domain in module 4 of NysC (amino acids 2517 to 2818 of SEQ ID NO: 7),
(ii) DH domain in module 7 of NysC (amino acids 8267 to 8470 of SEQ ID NO: 7),
(iii) DH domain in module 8 of NysI (amino acids 10086 to 10289 of SEQ ID NO: 8), or
(iv) DH domain in module 9 of NysI (amino acids 904 to 1123 of SEQ ID NO: 20 or 37);
are inactivated in said encoded modified nystatin PKS.

21. The method of claim 2, wherein said nucleic acid molecule is modified such that a C terminal part of a KR domain of module 4 of NysC, acyl carrier protein (ACP) domain of module 4 of NysC and a KS, AT, DH, and ER domains of module 5 of NysC and an N terminal part of a KR domain of module 5 of NysC are deleted in said encoded modified nystatin PKS to provide a hybrid KR as defined by nucleotides 1170 to 1913 of SEQ ID NO: 29.

22. The method of claim 1, wherein said recombinant DNA modification to the nucleic acid of SEQ ID NO: 35 is carried out in a host cell.

23. The method of claim 1, wherein said recombinant DNA modification to the nucleic acid of SEQ ID NO: 35 is carried out in a *Streptomyces noursei* host cell.

* * * * *